United States Patent 12,790,634 (MOST PROBABLE NUMBER ANALYSIS OF HETEROGENOUS POPULATIONS) - sequence listing, part 21

SEQ ID NO: 14 - DNA, 3200760 bp, unidentified (residues 1,600,381-3,200,760 of 3,200,760)
  source 1..3200760: mol_type = other DNA; note = Sellimonas intestinalis
gaaactgaatttgtggatctgggaggcaaagcgccgcagcaaatggtcctcaaaggcggtcttcgtttcgggtgtctggtacagatcttttgggaaccggtgggcggaaaacgggatctggatcgtcacgtgagatggagaagcaaaagggtctccctgcacatgatcaatggagagcgtatagtctccaaattcatacagtcctttcaacgatttgtatgcaggatagcttttccggtgtatggataatagttgtttccttaaatctgatgcatgtttcataaattcaaaactcctttctgtttgattatagcaaaaaaaagaggtttgtggcataataaaaacgaaacagttcagccgtgtgacggcggatccggctgttatggctgaattgttatataaaacagaaagccctctatcagggagagcaaaagaaaggagtctggagaaatgttcatcagaaagcatgtatatttttacggtagagtacagggagtcggatttcgctggcgggcggtgcagacggcaaaggacctgcatctgaccggatgggtgaggaatatgtataatggcaatgtagagatggaagtgcagggaaacagtgtgatgatagagcgtctgtttcaggaattacattctgaccggtttatccgtatcgaaaaaaccgagatgatccagattccgacggtagacgatgaggctgatttttccgtgcggggctaaaaggagagacgatgagaaaatgttatacgacagatcggatgatggtaaggttggcggatcctgagtttgccgatatgacggcggagttttttttcagaaaccgtaagatgctggaacgttatgaagagcggcgtccggaggagtttttttgcccggagtttcaaaagatctggctggacatccaaagggagaacgcaagaaaaggggagtggtactcctactatctctttgaaaaaagaaaaccccacacggtgatcgggaccttatctttgagccggatccagtatgggaacctctgctccggggtgcttggctaccgcatcggcggagaacggcagggggaaggcttcggaaccgaagccgcgaaagaggggacgaggatcggatttgaggagctgtcacttcaccggatggaagcggatgtgatgacggaaaatagggcgtctttacggattctggagaaatgcggatacaaaaaagagggatatttccgggaatatttcaggatcaatggtaagtgggaggatcatattcatatggctgccatacgtgcttgagaaagaacaaaaaatcacgatttttctgttgtaaatcgaagtgagattgctataatagaaaagagactggcagatgaaaaagagaggaaggaatatggggaaacaaggaattgtaaaagagggagtattgattacctgcgcgatgctcatcgtttctgcggcggtatacttttttctggtgccgagcaagatcgtcgtgggaagtatctccggccttgcgatggtacttgcagagcttctgcatatgcagatgtcgacgatcacatttatcttaaatgttgtactgctgatggcaggttttctctttatcgggaaggaatttggggcaaagacgatttacacgtcacttctactcccggtatttttgtggatttttgagcggctctttccggttacggaatcgctcacggggaacagtgtttacgatctggtctcgtacatactgattattgccctgggacaggcaattttatttaatgttaacgcttcgtcaggaggtctggacgtcatcgcaaagatcatcagcaagtataccagagcggatattggaaaggcggtcaccattgcgggcatggttacggcagtgacttccatcctcgtctacgatattgggacgctggtggtcagcgtgctcgggacttacgcaaacggacttgccgttgattactttatcgatggatttaaccggagaaagaaaatctgtattctctcagatgaatatgagaggatacagaaatatattatgcaggagctgatccggggcgtgacgatctatacagccaagggcggctatgacgggaaggaaaagacggagcttgtcacgattatgacgccaagcgaatacaaacagcttttgaactatcttcaccggtcagagatccaggcatttgtgacagtttacaatgtcagtcaggtgatcggcaagtggaatattaatggagacagaagaaaaaagtcggaataaaggaaaggaagagtgaatgatgcagtgtactagaaaagtaacagatggaatttattgggttggagcaaatgacagaagactggcgaaatttgaaaatatgttcccgattccaagaggagtgtcctacaattcatatgtaatccttgacgggaagacagcactgatggacacagcggacagctctgtggcagagaggtttatggaaaatgtagctgctgtgctggacggacgggcacttgactatctggtggtacaacacatggagccggatcactgtgccaatatcgcagccatcattgagaagtatccagacgttaccgttgtggggaacgccaagacgatgcagatgatcggacagttttactccggaacaaaggcaaagcatacacttctcgtaaaggaaggggataagctgcctttaggtgagcatgagcttacgtttgtgactgcgccgatggtacattggccggaagttatggtaagctatgagtccaaagagaagattctcttttccgcagacgcatttggtacttttggtgctttaaacggcgcactctttgatgacgagatcttctttgatgccatctggatggaggatgcaagaagatattatacgaatattgtcgggaaatatggccctcaggtgcaggcgcttttgaaaaaggcggcagggattgagatcgatatgatctgtccgcttcacggaccggtatggagaagtgatctggatctgcttctcgagaaatatgaccagtggagccgatatgaggcggaagaggacggggtacttcttgtctatggatctatgtatggcaataccgagaatgcggttgaagtgctggcagcagagatggtggagcagggcatgaagaatatcaaggtctatgatgcgtctgtgacggattgttcttacctgattgcggaggcattccgttatagccgaatcctggtggcagccccgacttacaacgcagggctgtttgcgccggtagagcatttcctcaatgatatgaaagcactcaatctccagaataaaaagatcgcccttgtggagaatggtagctgggctccgatggcgggcaaacacatgaaagctatcgtagagaccatgaaaaacatggagattgtagagccggtactgacactgaaatccgcaatccagccggcacagacagaagacgtcaagaaactggtagaagaactgctgaaataggtgcaggatggagcggagattccccggtaaaactggttcgcagaattacaggtaacagttcagccatgcacaaagtcacaaaaattcgggttcaatcttatttgaaaaggaaggtttttgtgtactttgtatatggcattctactgtgagtgaggatttattcgtgtatgtggcggtataatccccatagcggagaatctaggttgtcatgtgaattgttacaatttcagggcagaaattgaaaaaagtagttgacaaaacaaaggttatcgtgtaaaattatttttgttgctaaggacaatagatacctgaagcgacaagacaattttacattgtgtgggtttagctcagctggatagagcgtttggctacggaccaaaaggtcgggggttcgaatcctctaacccacgtacaaaaggagttctgatggttcagaactctttttttcgtctgtggaaatttcttctacctgcagagtgcatcagcactctgcaggtatttctttttttaaaacaccgcatgttcttgatataacggcgaggtttcttttgtcgcacagtttcgcctctgtacctttttccggttttcttccatcttatattaatagaagaatgaaaaacgggcaatgtaatggtgaggaggaatcaacatgaatgaaaaaatgatattggatataacagaggaaaaaactcgggaatttgagacgtatctgtacgagcgggagaatgccggggcaacaatcagcaaataccggacagatctgaaatgctttttacaatttcttggagaggacaaaatggtggataaggcacggcttctttcctataaggaatggctgatcgaacgctatgcggtcagcagtgtcaattccatgctggcggcgctgaatcagtttctagagttttgtggatacgggcagatgaaagttaggcgagtgaagacccagaagaatcttttccgtcaggaggagaaggagctgaccgcaaaagagtacagaaggcttgtacgcgcggcccgatccgcagggaaaattcagcttgcgcttatcatggaggcgattgcggtcacaggagtcagggtcagtgagctacgttattttactgtggagcaggtgaaacggggcagaattgaagtgaggaataaaggaaagtatagaaggatctttcttacgacggatattcggaaaaagcttttgtgcttcgcgaagttccgaaagatcattaaaggctgcgtcttcgtgaccaatagtggaaaacccaaagatcggagcaacctctggagtgagatgaaagcgttgaaagaaaaggcaggagtaaaaggtgagaagatctttccccataatttgcgccacttatttgcgagagtatattatcagacaacaaaagatatggcgggactggcggacgtcctggggcacagcagtctgaatgtgacgaggatctatacctccagcaccggggagatctaccagcggcagttagagcggctgacgatcctacagatctgagtactgtatgggaaaataaaaaaccacataatgtcaattatgtggtatcacaatttcagtcttacttatcaggccatatcattctcaatttcataacctattctagtataaatgtccggccacgtcaatcaaaattccttaaaaatttgcatcataaaaagactgacaacttacatagtaggaaaacgaagtcatgggacagtgatatttagcttcaacgggaatgaatacgggaaaacgctgaaaacagaacaccacataattgacattatgtggtttttgcactctggaaaaggaaaatatcagaatacaggagcaaaaaagaacggaaagaccagaattttaacagagaacaggaaggagaggtaagaggatatgaaagggaagctgaaatgtgtgatagcgctgatcttatgtatgtccctgatgttcgggaccagtctgtcgacactggcagatacggaaaccacaggacaagcgaccacgcagacagaagagacggcaagcgtggaaggcgcgaaggaaacaaaagaggcggacggacaggaggaaagtcaggagcaacaacagacagagcaggatgaaactttacctaataaacaaaaaatccaatctaaggttaagcaatatccagaatatatcaatagtcagcaggtaggacaagagtatggacatccgcaccaatcggtaattggaacagactttagaatagaaaatggaaaatacatctgtatatggacggcggaccatgaaccaccagcatacggaccaagaaatcagcattatgtaaaaatattagatcagactaaagacatttatgctattagtgcaatccgctgcgatttgtatggaggcgagacgccgggagaaacctactaccctgtatattacatgaatgcggaaacggacaaatcatatctaaaagatccgatgtttgaaagtgtaaagaaaaaccagaagccaacaaaggtttctgatatcgaggaaacaaataatttgacaaatggttattggacattaggaacatatgacggaaagattgaaaccgagagtgatttggctaaggttacagatacgaatagaaaggtaaagcctgaagaacagaagattgttacccaaacaatatttatctggcatgaggaagagcagaaaatatcagattttacgtttcagaagatggatgataaaacaaagcaaccgatgcaaggggtggaatttcaattatttgcttctaaagaagacggagaactgggagagctgataatagaagtaaaatctgatgaaagtggaaaggtaattttcaaaaacctgaaagctggcacttattatataaaggaaacagctccaaatggatatatgggatccgcaaacttacaatggaaacttgttattgatgagacaggaacaggtaaattgtacaatgtaaatggtacagagattaaagcatttggggataatgagtatcccattattgaaaactattccgttcagcagcatttgcggacacaaaaaactgcctccttggtagattggaaaaaaagaatttataagattgatttatatgcatggcatgacgttcaggtagatatcccggcaaatattgtgctgacagtggatatatcgggatctatgccttggatgttagaaacaccaagtggcggaaaggttacaattcaagatattagagatggaaatgactataatttacagactggtggaaatggctgggatgactacaagtattattatttcgattcaggagaaaaagaatataaaccaattggattcaactcaaaagataacaactggcatattattaaatccaaaagtaatggagagaaaacgtgggatactactgcgataaaaaagggaacagaagtttatattagagggaaagatgatcgtacaaaattaaatgctatgttagattctatagatgcgtttgtgaataagctaaaagcttcatcaccaaatagcaacatcgcaatcgttccttttgcaggagaggtttattatgcagacacatctcttcagaatatttcttcatatgacttgtctgattttaaaagaaagttagtattacatggggatacgaaccagggagcaggaatttcagcggcgacgaaattgttaaaaaactctaataatacaaacccaaactatattgtactgtttactgatggagcacagacaaagggagaggcagaagatgctgctggtgccgcaaaacaggctggaatttcgatttttgcagcagggctttataacgaaaaaaatgcggcaacgcaggaagaagtattgaaaaaatgggcgtccaaagatccggaagatggatcatcatatgcatatacagcgacaactccggagggattggaagcagcatttagtgaaatctttgcggagattaatttatcaatcaagaatacagtgataaaagatattgtcgataccaatagatttgatattgtgacagactcgagtggggaaatcttggctacgaatggagcatacggacacaacgggaaattaaatggaagtacgataacatgggatggggtttcaatcggatattcggattccgaagaaaatgcatggcatcagacaatttacatcaaggcgaaaaattcatacatcggtggtaacggggtgacaaccaatttgcaaggatctggcgtgacagcatcaggtgtgtcggtatcttttccgcagccaaaagttaatgtattaattcgatacacattgcaggatgcagaggataccgtttttgccggtgaggtgttggaaaaatatttcgatagtaaaaaggatcaacttatcactccgaagtatgacgataaatcttttgatatgacgagcgatgtgaatattacggtatcttactattatgatgcggagtgtacgcagccagtagaagcaaatggaaaagcagatggaagtgaagatgcattacgagctcaatatccggcggaagatactacttattatgtagaggttcaggtaacgcctactggaactgcggttagtggaatggagtctaatccggatgattgtttaaccgcgattaatacagcaaagaatggtgctgtatgtactactgctaaatatgagataaaggtagtaaccggatccattcaaattacaaaggaattggaagaaaacgctaaaaaagatgcaacatttacttttgaaattaccaaaacggacgataacacaaaatggtaccgggcaatctacattcgggcaggagcaaagagtgggaaagctgagattttaagcggactgccaaaaggacagtacaatatccgtgaactatcaacaattagatataaaaatactaaggtagaacaggatcagaatacaagttgtccgattcaaattgagggaactaatacaaacgtctatatcggatgtgagagtgcaaagtatccatcaatgacagatttatcagcaaaacatgtaggacttacttttacaaatcaatacaacgaaaatgggaaactagttgattccgacgcatttttgaatagagcggtaaaagatgagaatggatggcattttgagcaggttccgatttcaaaagaagtattgaaagacaaaaacagagcgtagccgagggggattagagaaatatgaaaaatcgaaatgaaaaacaatttgttctttctatcctgcttgtcgtggtaatccttggtatcgggactactatcgcattatctactgcaatttcgaaacctgttgtaaatagttttcaggctgcggatcatgaaactaatatcaaagaggaaatagacgggctgaaaaaaacgatacaggtaaaaaatacagcggataaaagtgcggcgtttgtcagggtacggattgtgatctctcctgcaaaggcacttggacaagatgattacatgattcaaggtcaaaattggactgaaaatgcggagcaggatggattctattattatactaagacacttttgccaggtgaagaaacagaggatcttatttttgaagtaaaaaataaagaagaggtgacagaatccttcgacgtccttgtatacgaagagtcctgcgtggcgacatcaacaagcgatagcttgactatagagcagataaaagaggcatttaaaaaagcagatggaaagactgatcagaatcagggataaaggagaagatcaatgttgaaaaggatttgcggaatcttatctggtatcatcgtgttggcgctggcggtgctagcagggctcctgattatcccaaaactgatggggtatgaagagatggcggtgttaacgggaagtatggaaccaaagtatccagtgggaacactgatttttgtcaaagaggcggatccgaacacactggaagtcggggatgtgatcacctatcacttggatagtaataccgtcgtaacccaccggattgtagagatcgacaaggaggggcagacagtgacgaccaaaggcgatgcgaataatgctaatgatgggaatcctgttccgtattccgaaattgttgggaaagaacattttaagattccatatcttggatatgtcagcatgaatatcaagacaccgaaaggaatcttggcagtctgtgtggtattgattgctatgatcctgctgacttttctgccggaaatcttttcgccggaggaagaggaggccctgaaaacaaaacgaagaaaaagaagaaaatgattcttataacgggaaaccgtatgggaataaaaaaagaaaacaaaaaggtaaaggagagttaagagtatgaagaaaaaagttgtagcggctatgatgtcagttgcattggtggcagcggtaggaattggaggaacactagcatatctgtcttccacatcaaatgatgtaaagaatacgtttacagtagggaaaggatttgacgatacagacggtcaggctttaattgttgatgaatggctgttggatggaacagcagatgatcgtacacaggaagatcagacatacgaaaacatgacgcctggttatgtagaaaaaaaagatccaacagctagattaaaggccggatctgtagaatcatatgtttttttacgtgtaactggagttaatgccttggaaagtatcatgaaatcaaatgcagatggagacgatgtacaggcatacgacattagtggatgggatacgacatattggatgaaagttgcggatgaaaacggaactttattgcacgagactaagttgggcttagaaggtgatggatattatgtcgcaaatacaggcaacactgtaaatctggaagatactactccagagggagagtacattcagttaggaaatccgatttttcagaccgttactatgaatccagatgtagctgaagtgacagaagatcttggtacagaaattggagagataacagtaaaagcatgtgcggtacagtacagtgaagatcagatggatagctggaaagacgcatttgactcagctaagtggaattaaaaataagatcaacaggaggaagacctatgaaaagaaacaaagttgcaaaactaatggtagttgcagcgttggtaggagcaataggaataggtggttctctggcacttttaacagctcggtcagaggcagtaacgaatacattcacagtcggaaaaggattgcatgatacagatattacactggatgaagcccaggttaatgaaaatggagaagaaatagacggagcagaaagagtccaaaagaatacatatcaaaatcttgagcaaggtgatggattagataaggatcctacagtaacaataaaagatacggcagccgactgctatgtttttgtattggtggatggattaaaaaagaatacatccatttacgacgtggatatagaaaagagctggatgaaagtggaacgtattcctaaggaaattcaggatcaagttccagataccgctgatttatatgtgtataaggcagatcaatcaactccgacagtagttagaggagggcttacagccggaaaaggaattgtttttgacggagttaagattaaagatgacgcagccttattcgaacctgtaatggaagaaggtacgattactggatataaggctaaaaacctggatcagattattgtaaaagcttgtgctgtacaggcaactaataatagttatgagaatgcgttgaagttagttacatttgctaataccagtaattaagaggagaaaaaacatgaacaaaaaacgagttacggctcttgcggtttccctcagcctggtggctgtcatcgggatcggagcgactttagcttattttaccgatcagacagacacccagaacgtaatcaacatggggcatgtagacatcgatcttgtagagcatgagatcacacaggacgaggatggcaactgggtttatgatgagacgaaaccagtgacatccgaaggactgatttttaccgatgtgtatccaggagaaactgttgccaaggatccaactgtgactctggcagagggttccggggatgcgtatatccgggtaaagatggagatcgatatttctgactctactttgacaccgaacgatgcggctgcactgaaagcaaacattgataaagagatcgcaaagagcggcaaatggtatgaagcggcggacggatattattactacaataccgcattgacggaagaggattcttccgcagtcctttttgataaagtaacacttccgggcgcggcatggaaaaacaatacggcaagccagagtttccaggtcaaacttgaggcggaagccatccaaagcaaatacttcacaccgcagacaggagacggtatgattaccggatggatcgatgaaactcaagctccgattacagccgaagcctacacggaataagtcggacattgaggaggggattccaatgaaatccaggatctgtagtctggcaggtatcctgctgatggcggcggtcatcctggtatttctgccactgaccgtcccccgcctgtttggataccagatttacggtattctgacagacagcatggaaccaaattacccagcaggatgcgtagtttatgtcaaagaaacagacagcgccgggatccgggtgggagatgtcatcacctttcagatggggacggatacggatcttgtgatgacccaccgggtggcagaaattgacgtggaaaagcagcaatttatcaccaagggggatgccaacaggtctgtggacgtcacgcctgtggcgttcgaccgtctgatcggggaggtggtatttcagattccaatgctgggaaatctttcttcctgtctgtatacgggaacaggaatcatggcctgctcaggtctgtttgtgacagtagcagtcctgtggggaatcgcggagaagtttaagttaaaggagagtgcaaagtgaaaagaaaaatcgtactgatgggcgtggcggcagctctcactgcaactgcattgatcggaggctccctggcgtattttcaggcagacgggcaggaagttcagcagcagatgaatacccggacactgagcatcagtctgaaagatgccggatccgggacgctgccagaggagacggtgctgtttgacgacgctatgccgggagcggatcttgagatggagcaccgattggtggtagagaacacaggagataccccggtttacacacgggtaacgcttcagaaagtctggggagagtatgcggatcattcctttaccaaggaatttgacaaggacagttctcttatccggctggagaccggggacgattggtacatcatggaaaatacggatgggaacgacgagacgctctatctgtattaccggacgccactggaagagggcggacagaccgcaccgatcttgaaggggcttcgaattgcggagagtatcactaacgagtatgccaataaggggattttcctggatgttcaggtagacgcagttcaggtttccgaatccgagagagcacgccaggacgccattctgacggaatggggtgtgtggccggagtttagcggagcgggggagattatcagcatagaagaatagtggacagaaaagtcaggaggccattatgaagaaaagaatagcaggtctgtgcatgacacttgccctagtgtttggaatgtccatgggagtctatgcggcagacacaccggttgcgacctttgacggaagcggccagattaaatacaattacgactataatgaggatttcggagatgcctttgaaggaatgcttccgggggacgaaagaactcagcagatcatccttcggaatacctcggaaaagccgacggacttctatatggaagtagaagtcatcaaagccctggaggaagcgtccaaagcttcaggggcggcctataccttttctttaacggttacgcaggaaggggtaaatgaaggaataccccaggtgatttacggaggagaaggaagtggaggtgcttggattggcggtcgggacagtgaaaacggactgggggacgtcaacgaggtgctggaggaatacggctccaacggaatcaaggtagccaacctggaccaaggagaggaggcggtcattgctttaagtgtgatgctggacggcattaccgggggtaatacatatcagggcgtggatggaacgattcagtttgcctttcacgcaagttatgacacaaatgcaccggaaaccattactgaaacgatccggggagaagatcaaatcatcaaggagacggttaaaggagaagaaagggttattgtgcgggacggcggttctcccacagaccgggttaagacaggtgatccggcggtgatcctgccgcttgcggcggcgatggcagtctgcgcggcggtgattgtcgcgctccttagcaggaaaagaaaacagcatgaggaagaatccagatagaaaggcaggaagacgaagatgaaaaggaaaaaactatcaggcatgattgcagtcggctgtctatgcctttttacgggaggatttccggtccgggcggcatcgagcgcatcctatatggtgacgatccgtccgggaagcgtggcacgtttcagtgagtcgtttctgaaccagtaccgggcggcaggagcattggtgacggaaaagacaggaagcattaagatccaaatcccggcgggtggtacgatcccatacttgccggatgcgggggatctggtttacaaggacggaaaagaagggcgttataccatgaatacggactggtatccgaagaatctcacagtaaccgggaatgagagtctggttgtgaaatatgacgcattaaacgatgctgtagagtaccgggtgcgttatgttgatgaccgaagcggcgaggacatcgccacgcctctgatttcccagggaaatgagggggagagctatacgttctatccggagaaagtagcaggatatgcgtgtgacacggagagccgggaattaaagctgtcctccaaagccggggacaatgaagtgacgttccggtatgagagtacggtagaaccgaatgtgaatcaggtcgtgattccgggggagaccatcacggagacggaggttgtacctggtgatacgacgatcatcacagatggcggcacaagggtcacggaagccggaggcagcacatccgagggaaccgacggggcagccatgggagacgagggcacaggtcaaaacgtggttacagccgggggacagactcagggtcaaactgccggagagcaggagaccatcgaggagaatgacgttccaaggggcagacagccggaaaacgatgaaaggggcacgaatagggatactcaggagattgaggcggatgaaacgccgcttagtaacaaagaaggaaaagcagacaaggatctcaagagctatgttattgggggaggagcagtcgtcatccttgcgattgcaggattgttgctttatacaagaaaacacagattgcgataaaagaaaccgggagatgttctaatgggtggagtatctcccggttttattatagcgattttgttataatatgtacgatttcctgtgacggatccccaaaggcagacaccgtcagtctttggtgtacaggtgtgtttttcggtaagtgcttggagagaccccggtcatttttttgaagaccagggagaagtactgtgaggtatcgaatccggtgactgcggcaatattctggatggattcattggtggaggacagcagttgttttgcttttttaattttttcctgcgagatatactcggacaggctggttccggttaactgtttgaacagccgggagatataagtttcattgtaatttacgacccgggagatggtggctaggttgagggagtccgccaggtgctgttcgatgtagagttttattttctggaccagaaggttgtttttgtctgtttttttggagttttgtatctcaaacagatgccgggaaattgtttccaggtagtgggaggcttctttccaggaggagaaatcatgcaggtagtatagctgatacagagcgattttggaggccagtcgttcttgaagttgatataagtctatatagttcagcaaaatcagagcgacagacatgtagattttaattgcccgaatatcgtgcatacttcgaatgatgatacactcctgacatagttttttgagtgcgcgcgagtattctgcttcaattccctggtagagggagaaagtcagttcctgtagcaggtggtcgatctcagttcggtcgatggtccgcttctgaccggatgtcagaagagaaggttcatcgtccaggatatttactgacgaataaattagcggcgctttggtaacaaaggaatcggcataccgttgtaaagtaaaaaagtgacggtagatctgatcccagggtgaagctgccgggtagaggacaactgtgagccgacgatgcagggtcgtagtgcagtagtcgctgaaatcatttgccagagactccagaaatccggaaacggaacccaagtcgttactttccaacgtaacggggctggacgaatcggaggcggaagaagtaactggtgaaagtacaggttggaaaagccagagcatcgttccgtgttccagatccaacatggaaaaggagagcttattgacgcaaagtcgttgcataagctggagatactccagggtgttcccggagtgaatctgatggctctcccggaaagagcgatgatggatctgggtgtacatcaggtagacaggacgctgcagatccagcgggaatttggaccatgcaatctgcaaggactgttggattttatccatgtgttcccccgagaaaatttctttcaggatcgtttgctccagcaagtgagaaagcagcagagagttctgacttgcggtggacaatagatgcagtttgtccgcctcctgttttatttcatcgacagcagagaagatctctgataaaatgacctcatctttttctgtcttaagaagataacgggagtgaggcagcttgtctgctgcataaatatgctcaaagttatcaaaggcagttagaaaaatgacgcggaagtccgggtcggatgtccggatgcgtgaggccgtctcaataccggaaagtccaggcatcctgatatccagaagtgccagatggattttcatggtttttgaaagttctaaggcttccattccagagtaacatttatagacttcgagatcctcaggagcgtgtgcttctaccaatgcggcgaggtagtttacgatgtaatgctcgtcatctacaattaatagtctcatcatggatgttcccctttctaaatttaccaagtatgatggaaacacgaagtccgccaagcgtggaacgtgatacatggagagaatcgtgggtgttggaaaagataatcagtctgcgttgaatgttcaggattccagacatttccacgtttgttccggtgctttggacttctaaaagcgcattggagagattgcacagtttctcatcagtcagttcttctccgttatcttcaatatcgatctgcagcacttcattatccgggtgaaaatgaacctgcaaaagcccgtctttcatcttatttgccagtccgtaattgaaggcgttttccagaatcggctgtaaaatcagctttggtaccgggatgtccgcatagcccgcgggcagttcctcaaaatcaatctggattcgtcccgaaaaacgaagcccctgaatgtaggcatagttctgggcgtggcggtattcttccgagagcttaacatggtccatattgtttcttgtcagataccggaaataaactccgagtgcgttggcgacactttgggcgtcctcgatattttcggtttggatcatccgttgaagcataaaaaagctgttgtatagaaaatgcggattgatctgagcctgaagctgtttgagttccgctttctgcaagagtagtttttgagtgtaatccttttcgataagcagctcaagcttttgggccatcttattgaattcctgatacagataggcaaaatccgggctgtggacgttggcgatctggactttaaaatttccggtttccatttctttaaacgcattgatcagatgtgataaaggtcggtgtaccaggcggtaaatttccacaaaaaagatgatgcatgcagcggagatcaacagaataaaaaacatattcagtaacggggtgacccgggtggcgttgagaatgtcgtctgtcggaatcagcctggtatactgaaaggaaagatacggcatttcataggaaaacgcataatagcgagtcccatcgatcgtcataatgggttgccccgtggcatccttagaagcttctatttgttgcagaagcttcttttcttgatctgcggacaaggatgtgagggcaaattcatcttccatggtaaaaagatagttttccgcattgtaggacatattattcttgagatactcttgcagatcattgatggacaattcaaaaattacaccataggtggcggaggatgatggcatcaggcagcaaccaaggactggcgttttggtcagcggattttcatagtaagagaatgtacgggattcttgggcgatgtttttcagagtttcaaaggtttccgatgtgagagtggagaagctcccttcatcgtagcctttggaattgtacatgattccaagatcaccaaagaaaatatgggctgaggagcaaaagggcagagacagggagacagaggaaagctgctcccgtaagagccgtacctgtgaagcttcctcataggtggtaaaaccggaatacgcattggagaaccgctgcaggttggactgacccgcaagggtaaaagcggaagcataaatagtatacagagaattatttaaatgtgcgataaaggttgcgttgttggaatcaatagaggaaaggatctgccttttcagcgtctgattgctgaactgaattgtgccaagccagacgatcagcagcggaaatacaagagataaaaacaggatgacgatctttttaagtaaagtatttttgcgtttcatggtgatccactccttatattctgataataactgtagtatatcacatacagaacataatttaagttttaaaacttataatattctgtggtttgtataaaatctattcatgtttgcctaaaggtgtcgataaattataaaaatacaaaataattatatagatcttttactggacggcgaagataatgaggacaatggaatttatagatggaaaggagtaaagcaatgagaaaaagaaaacgagtgttggcagtactgttgacaggatgtatgttgggtactatgatgaccggctgcatgaagcagagcagcgagggtgattcctccaacaagaaaaaagaggcggtgaaagtgccggaggggctctgggatccgtatgaggatacggtgacaatcagtacggtactcccggaaaatgcgggcattcagtttgccgagggagacagctacgacgacaacccttggtaccgggcctatgaggagcggtttaatatcgatgttgtaaatgactgggtaagtaatgattacacgaccaagctgaatcttacaatcgcggataaaagcattccggatgtcttctgcgtggacgcacagcagcttcgccagttaaaagaagcggacatgatctgggatctgacggatattttcgatgagtatgcttcggacctgctgaagggctatatggagcaggaaagtgatacgtttgagacggggaaactggacgggaaactgtatggaataccgcagctttcctacggaatcattgaccagccaaatcagatctggatccgcaaagactggaaagaaaagttgaatcttgccgacccgaagtcaatggacgatgtattagagatcgcaaaagcatttcagaaggaatatggcggatatggtctgacagaggaccagaatctggactgctttaagattctggcaccggcatggggtgcgaacccgggaatctggattgaaggagaaaatggtaaattggcttatggatctgtgcagccagaaatgaaagaggcattgcaggcttatgcacagtggtataaggaaggaatcattgatccggaattcacgacaaaagatctggaaaagatgcttcagggagagatcagcagttctgtaggcgtaagcccgtactatcagtattggggatatgatccgggtccgaatgtcgtacagaatctcggcgcggatgctatctttgaaccgtacgagattccttccgcaaacggtggggaagtaaaagcaagtgttacgtttgcaaactatggctatattgtagtgagcaagggatgtaaaaatccggaagcagtcctgaaacttcttaacttctatgcacatgtcatggatgaaggagacgaggaggatgcggattttatcaacgaattgtttggaaatgcctatacgaacattccatatgcactgagagtcattaatccaaataccgattacaaccagtttgtgaaagtatccggggcgctggaaaaaggattggatgaagatccggcggcactggggaaagacggtgtgaagtattccaatagtgtggactttattaaagagggagcttcgactggagtgggagattacctgcagcagggcggcccgaaagccgcctaccggatttccaaggaaatcattgacaacgagcaatatattaaggatgcaatgtggggaccggcgaccgagacgcttctgagtgcgggaagtacacttgatgatatcctgacagaaggatttacaaagattatcgtaggagaggagagtattgactactttgatactcttgttgacaactgggcgaaagctggcgggacaaaagcgacagaagagatcaatgagacttacggaaacaactaagaaggtggcttatgaaaaaattaaaaagacaatggcagtatcatctgatgttgcttccgggtgtgattttgatctttatttttgcgtatattccgctttatggagtgatcatcgcgtttgaagattacaatccggcacttggatttgcctctccttgggtcgggatgaaacatttccagtacatctttagtcagccggcatttttaagaacaatctggaacacattttttatcgccgtaatgaaactgatagggggcattgtcgtaccggttatttttgcgctgctgcttaatgaactggtgtccaaccggttaaagagaattttccagacactgatttatataccgaactttctttcttgggtcattatggcgggcgtactgatggatattctcgcaaataacggaatcatcaatcagtttctcggatttttcgggatggacgcggtaaatttccttgggaatgcatcggtctttccgtggactatgattgtgacggatatctggaaagggtttggatttggaactgtcgtttatctggcggcgcttacgagcattgatccggggctttacgagtcggcgattctggacggtgctaccaggtggcagcagatccgatacatcacgcttcctctgctgatgccgaccatcattctgatgcttgtgctggcgctgggaaatgttctgaatgcgggatttgatcagatcttcaacctgtattctccgatcgtatatcaaacaggagatattattgatacctatgtataccggcttggtatccagcaggctcagtattctgtcggtgcggctataggcctgttcaaatcggcagtatccgcggtacttgttctgacgtcctatattctggcggataaatgtgcgggatacaagattttttaggaggaaggaaatgcagtataagacaagagcaaacagaatttttcacttcgtaaatattttcattctggcggtcgtctccctcctctgtgttctgccatttatcaatctgttggcgatttctttcagcgacagtgcggcagtagcggcgggagcggtcggatttaccccggttgattttaccttgagcgcatatgaatatgcgctcaaggggggcaaatttatacgggcacttttcatttcctttgagcgtgtgttccttggtgtggggctcaatctgatcctgatggttctcacggcctatccgctctctaagacgaggaaaaaggtggccgggagaaacatttacatggtctatttcgtaattaccatgctggtgtccggtggaatgatcccaacctatctcgtggtgacggggctggggttaaaagatacgatttgggcgctgatccttccgggggcgctcccggtatacaatatggtcattttaatgaattttatgcgtggaattccggaggagatcgaagaggcggccgcaatcgacggagcaagtccattccagatcctgacgcgtgttctgctgccgatcctgaaaccggcgttggcaacggtggggcttttctgtatcgtcacacattggaacgactggttcagtgggatgatctatatgaacaacccggacaactatccgcttcagacatatctgcagtctttgcttcagaattttgaacagttactgcggacgcagagctctcaggatattcaggcgctccttgcgcagatggacgcaaggaccgggcgggcagcacagcttttcctcggtgcgattccggtcatggtaatctatccgtttttacagaaatattttaccaaaggacttgtactgggaagtgtgaaaggctaaaataatccaaagaggtgtgagatgagacaggtctatgtaaaagagtacgggattactccgggaaacgacagagcccttttgtggaaggtacggatgatgttggatgagcttcagggtacgatggggatcgagtttgtgtttgagtcaggtacctatcatttttatccggattatgcggtggaaaagactctgtatatttcaaaccatgatgaagatgtaccaaagaggatcgcgtttgattttagtggatggcgcaaggtaaagatccggggagagggagcggtctttctgtttcacacggatattttgccgtttcacctggacaggtgccatgagattctgattgagggaatcaccattgactatgagagaacgggatattccgaaggagagattgtggagctgtctggaaaaagaatggtgcttcggatcgaccggaaagagtatccataccgggtttttcacggggagctctattttgaagaagaaggggcgtatcacccgctgtattatggctgtctggagatggacagaaggagaaatgccccagtctatcaaggaagggatattagttttaacagaccgtacccttcctcctatggagcggtgttccgggaggcaggggagaatttggtagaggtgacgttgacagaggaccagcagtttccggagacgtccagggaaggaaacagaatgattttgcgtcaccatctcaggacacatccctgtttttatattaccggaagtgaaggaatcacactacgggatatcaccatttaccattgcacagggatggcggtgatttcacagtttacaaaggatatcacgatcgagagggtgtgtcttgtcagacatccacaaaaagatcggatctttacggcgacggcagacggatttcatttcgtgtatgcaggcggaaagatccacattaagaactgtgtgctggagaatcaactggacgatccggtcaacattcatggtatctacggaaggattcacaaagtaaccagcaaaagagaagtaatcgtggaattggtagaaggtatgcaaaaaggggtattgctggggacggcaggggattatttcgcggtgattgacaaccgaacaatgctggagcaggaacatgccgtgatcactgagattacctggatgaattcggattatcaacggattgtttttgcggaagatatggagaatctgactccgggatttgtggtggagaaccagtcctgggttccggatgtgctgattgaggggtgtacgttccgtaataatcgcgcaagaggattgttgctgacaagcgcgggggacgtcctcgtcagggacaacacctttgaaacacctggggcagcaattttgattgagggggactcgaactactggtttgaatccggggcaaccagacatattgttattgagggcaacagattccatcattgtgcatatgtcagtgcctggggcaaggcgcctattcaggtttcgccaagcgctcttgtctgggagaaggataggaggtatcatcagtatctggaagtacgggggaatgtatttcagtgctgcgatgaccgtcttgtaaatgcggtcaatttaaaaaagctggtatttcttgacaacaagatagaacggacaacggtatttgaaccgataaaagggcaagcattggaacttgacggggtattggaagtggagacagacatcaataaggagcaacagatatgaacatggaacagaaaaaaatcaatattggattaatcggacttggcgcaaggggaacccttttgctgcacgacgttttgctggagcatgaagacgccgtaatctgtgcggtctgtgatgtgtatgaggacagatgcgaaaaggcggcccagtatattcaggaaaagactggacaaaagccatttcagacaacaaattataaggagatctttgaaaggaaagaggtggatgccgtccttctttgcagttcctgggagtcccatatccacctggctatcgaagcgatggagtgtggcaaggcagtgggatgcgaggtcggaggagcctattccattcgggaatgttggaggcttgtagagacctatgaacaaactaaaacaccgattatgctgatggagaattgctgttatggccgggatgagatgatggccatgcatatggttcaccagggcgtgctgggagaaatcgtacattgtgccggaggctatatgcatgatctgcgccaggaagtggcgtttggaaaagaggaacgccattacaggctgagaaattacatccaccgcaatacggaaaactatccgactcacgagctgggaccgattgcccagatacttgggatcaatcggggcaatcgtatggtttctttaacctccatggcgtcaaaggcagcgggactgcaccattatatagaaaaagaaaaatcagaagatcaagagctgatgcagatggcttttcatcaaggcgacattgtgacgacactcatccaatgtgcgaatggcgagaccatcactttgaaactggatacaactctgccaagatattattccagaggattctatatccaggggacgaaagggttattcaacgaggagaatggatctgttttcctggagggagagcacgaatcttatgattttcaatggaaggagcagtggggaaatattgagagctaccgggaaaaatatgaacatccggtctggagacgctaccaggaagagggaatcaaacgggggcatgacggtatggactggcttgtcttctctgatttcgtggaggctgtcagagatagaaagccaatgccgatcgatgtttacgatatggcggcatggatgagtatttcgacgcttgcggaggaatccattcttctcggaagtcagccgatggcaattccggacttcacaaatggagcctggatggtacgaaaataagtaatattctcagttttttcagtggggggacatgttccgatatataggaacacgtcccccgattgctgacatagatactatctatatatagacttcttatagtgaatctctattttacagtaaatttggagtagaagtataatagatacattatgatatgtatttagaacgagaaaggcggaggatacatggagaaaaagcaaagtttctgtgggatttgttcggcaggatgtccgatggacgtctatgtggaagatggaaaggtcgtggagatcgaagggcacacggagaatgggaagagtcggggactttgtgccaagggcgcggcgtcgaaacagtatctatataatgaggagcggattttgttcccgatgaagcgcgtgggagaaaagggaagcggacagttcgagcggatttcatgggaggaagcgtatggcctgattgcaaagaagttatcagggattcgtaaggagtatggtgcgaagtcggtggtcttctatgcgggttacccgaagtggtaccggccggctcttttgcgttttgccaatgcctttggttcgccgaatttttgtactgaatcgagcacctgtttccaggcatctgccctggcatggaagtctatatatgggaatgggatctgtttcccggatctgccgcatacgaagacgctgcttttgtggacgagtaatcttttccattccaataccccaatggggaaaatgtaccggagccttaagaagcggggagttacgatcattgcggtggatccgagaagtaccgtcactaccagagaggcggatatccacctgaagattacgccggggacggatggagcgctggcgcttgccatggctcatgtgataatagaagaagagctttacgataaagagtttgtggacaaatacgtttatgggttcgaggaatataagaattatgtgagcacatttactccggaacgagcctgtgagatcaccggggcggatgcagagctgatccgtaaagcagcaaggttgtatgcgtgtaacaagccttcagggattcagttttcagtgtccacgattgtgcatcacatcaacggattccagaattaccgggcggtattcagcctgatcgcgctcacaggcaattatgatgtggagggcggtaatcgtgccatgccggaaccggtctccccgtgcaatgagtttggaaaggtgaagaggtacgatggggaggaggcgatcggggagaaagatttcccgatctggtttgatcttccgtgtcaggaggcccagtgtacaaggatcgcggattatattctggaggaggaaccatacccggtgaaggcggtttttgccatggggctcaaccaccggatgtggccccaaccgaatgaactgcaaagggcgcttggtgctctcgatttctacgtcaatgtggagctcttctggtcggagtcgtccaggatggcagatctggtccttccagcctgcacaacttttgagagggaagaagtgaagactctgcgaggcggtatgtttgcactgaatgaacgggtggtggaaccgctcggggagtcgaaaaacgacatcgaaatcataatggagctggcaaaacggataggacttgaagacgaggtactgtcatccgactacgagtcttatatggattatatcctgaaaccttcggggctgacgcttcaggatcttcgagaacatccagagggaatgaaagggaaggtgttgatccctccaaggattcagacgtaccgggaagaaccgtttcacacgaagtccgggaagattgagctgtattctctggcgcttgataaataccgggagagcagagggtatgaaccgcttccggtataccacgatttccgggatcagagggacgtagatcgggaaatgtatcctctgattttaagtaccggggcaagaaagccgcagtttttccatgccagactgtaccggctgtcgtggctgtctgccctggagacgaatccggcggtggagattcatccggaggatgcaaggaagtatgggataaaggacggcgaccgcgtacgggtatcctccccggcaggagagatggaagggatcgcggtaagctccatcaatgggaatccaggtgttgtctatatctaccatggcaatccaaaaggtgaggcaaacaatctgatccaccggtcgtactttgatccgtataccggatttccggggtacaagagctatttctgtaacatagagaaactggatcaaagggagagaaagagaaaggaagaagcggaggtgacgggagatgatggggcgaatgaaatttaatgccgagcagtgtgtgggatgctatgcgtgccacatggcatgcctggacgcccaccacagtgcgagggagattcacgccagaagtttccgggggatcagcaaggtcatggacgaagaaaagggactttcttatgagatctgtccggggtgcacgcagtgcggagcatgtgccagagcctgtccccaggatgcggtttttcgggaggaagactatggcgtctatctggtggatcgggagaaatgtattggatgcggcgtttgtacgaaagcttgcccggatcgcctgatctttgtggacgagacagggaaggctgcaaaatgcgacggctgtattgcacgcagaaaggcgggccgtgagccagcctgcgtggcggtctgctgtctggacaccatcaccgtgggggaacaatagatgagagcaaacattgcaggatatattctcgcagggggaaaaggaacgaggatggggggaatggataagctttctctgaagtaccagggaagatatctggcgctctggacaatcgaggcgctttccatgctggacacatggtatgtgtctgtggcagagattcctaaagaaccgatgggaaaggccagatggatccgggatgtttatgaggatatcggcccaatgggcggcattttaagcggcctgatccggtgccaggaagaagcactttttgtagtgccatgtgatacgttcggggtggatgcttctatgggaaggagattgctggatgcttatgagagagccggccggcccgtctttttccaggatagaaacaagatattcccgtttcccggaatttacacgaaatccatgcttccagctatggaacggcagagaaaagcgggaatttaccggatgcagagtttgtttgatctggtggatagggggaagattactttgttagatggaagcagtgagctggggcggctggtcaatctgaatacatggcaggaatacgagtccctgcaaaggaggagcaatgagcgagagatgcgttacggtacaagaggcgcagaatgatattcgaatgatcgtttggaaaagcagggagacggaggaagtcaccctgctggaagccggagggagaatactgtcagaggatttgcgggcagggaaaagcagcccgccctttccacgatctccgtatgacggttatgccctccgggcagcagatatccagggtgcaaataaaaagcaacccgtctgtctgaaggtggtggaaaagctttgtgctggaaaatatccaaagcaggtcatcggttcgggagaggcggctcggattatgacgggagccccgatcccgaatggagcggatacagtggtgaagcaggaagataccgactatggagagggtattgtgcagatctatcgaagccagaatccatatgatcattattgtccgcaaggggaggactttctggaaggagagaagctgcttacaaaagggctccgtatggatgccatacgcatcggaatcgctgcgtctgccggatgtgaccggattcgggtggtaaagaaggtacgtgtagcagtactgacgacaggaagcgagcttgcaaagccagggacaaagctgcgtccgggacagatttatgattccagtctgtacctgattacggagcgtatccgggaattgggaggagaggttgtcagaatgaactcggttttggacgagcccgagattctgaaggggagattgagagaagcggccaggtgtgcggatttgattgtaacgaccggaggcgtctcggtgggagaaaaggacctgacccgtcaggttctctcacagatgggagcagataaggtttttgaccgcgtttttgtaaagcccggttctccaacagccctcttccggctggaggaaaccccggtatttgccctgtcgggcaatccctttgcggcaaccgtgcatatggagctccttgtccgggcagcgattgccagatggtatggatgtgacgaactcttcccacacgaaaaacggggctttttgctctccaatttcgggaaatctgccgtaagtgaccgatacatccggggaacggaaagcggaggccggatcctgcttccgaatgggaaagagcgttccgggatcttaagctctatgaatggttgcaactgtctggtgaagatagaacagggaagagcaaatctacgggaaggagaacgggtatgttatatcaaaatctgactgtgcgccccgtcctctttggggtggccggggataagaataccgggaaaacgactttgatggaggaacttatccggcgtcttacaaaccgcggctggaaggtagctgccatcaagcacgatggacatgattttgaagcggatcgggagggaaccgatagctggcgtcattatcatgccggagcctacgggactgtcgtattttcgaaccggaaataccagctcgtcaaggaagaaaaggatatttccctggagaagctcacagccctttttccggaagcggatgtgattctgatcgagggaatgaaacaggcatcccatgagaaataccggtgccgttacccgaatgaagagtggaacgccgaaaggctggtggggcgaatcgaagaaaagatacgggacgaaaggagtaacagaatgacaatagagacactgatggaaaagatcaggcttcccaaggaaggacaggactgtgtccaggactttccaatgacagaaaccttttatcagagctttaaagagctgttttatgaagatagcaaagccttttttgcggaggcagaccgccgcacagatcgggagaggctgtatctttacttatatatcaggatggctgcggatctctatccagcctttgtggagaaaggaatctcagggaaggtgtatgtggacaccttttatgacattacgatctggtacaaccagtgtgtaaagaaaaagggagttccgggactggtggaagagcggtggttgtccctggcgcttcggatgaagattttccgcctgggacggcttcagtttgagccggatgaagatcgacatgttcttcacgtccacattccggaaggtgagcccctggatgatgcggcctgtggagaatcttttgcgatagcggaggagtttttcggaccagagtatacgatatttgactgcgaatcctggcttctctctccgaaacttcagaagcttctgaaaccggacagtaatattttaaaattccagaaccggtttcagatagagaagatcatctatccgttccgacaggcagaagagcgggtgttcggccgggtacgcgaggacaaggagcagtacccggagagtaccagtctccaaagagcggtgaaagcgatggtgctgaccggggaggacgtaggaatcggatatggggttatctatagaaaataataataaatcaatcaatttataagaaaatccgatttgccactttttgcgcttaccgatatgataatatcgtatgtgatcatgcaaagagacagaggaggattatgatgaaaagaaaagcagcagcgctggctcttctgatgacggtttccatgcttgcaggatgcggatcagacggcggcgacaagggaaaaaagagtgatggaaagacgacattgacattctggtgccaccagaatgaaccgtgggtaaaatcctacgaagcgatggcagagaagtttgagaaggaacatccggaatatactgtggaagtccaggactacccgtatgatgtatataatgacaagatccagaccgccatcacatctgacacagcaggcccggatatcattgccgtatggggaggtatggcgccgaactttataggaacggacgctctctccgaggtgccggaggatctggcaaaggagctggataaggactacatggctccgaccgtaggaagttacaagaagaacggcaagtattacggcgtaccgatggagtacaacctggagtacggcggaatgatcgtaaataaaaagctctttcatgaaaagggcgtcgcttatccgacaacctgggaagaactccgtgacgtgtccaagagcgtttccgtgaaaaacggggatatcgtggagatgaaaggattcgagatgtttgacaccgactctttgatctgtaactatcttgctatgattttacagacaggtggacagtatttggaggaagatgattctgtcaactttgccacaccagaaggtgttgcggctatggaagagatccttagtatgatcaagaacggtgaatgtgacctgacacatcttacggacggcgactactgtttcaatgatgtgtatcaggacaaggggtacatggcttccgtaggctcctgggcgatcggagaaggaaccggtacatacgagctggaatacggcacggattttgaatatgtgcgggtaccgcagtacggcgatcagatgtccttcgcttctgagaccggatggggacttatcgtgccggaaaatggaaagaacaaagatgcagcatgggagttcatctccttcttcagcgagccggagaatctggtagagcacaacattgcgtgcagtcagcttccaccgagaaaatctctgctgaccaacgagacatacattgaaaagatgccgcacgtagagttccttttggacatccttccaaacggacaatggatggggccatacaatacttccgatatgcgtgaggttttaaatcagacattcctgaatctatgtcaggaagagaacccggatgtggaggacgctctaaaagaggcttcccagaagattacatccgaatgtaaatacggttactcagcagaatagaagtaagacagaggattcctttggaaaggaattctctgtctttcgctccgcttatgtcctgtgtgatcagggagcgaatttctcagcctgaggaaagaaaggactggtaacaggtgaaaaacaatcgatttgtggcgtcggtgctgtttccgggtatggtctttctgggaatctttgtgatgattccgattctgtacggacttggcatctccctgtatgactataatcccgccaattcccgaaatccatttctgggtcttgcaaactaccggcgactgattcgggatgaagttttttggaaagcggtaggcaatacggttttcttctgcgtggcagcggtgagcgccaatattgtagttacgctgtttctggcgaagctgatttctgtcctgccaagcaaggggctaaaaaccgtcttccgaacgattttctttattccttgtattgcgccaatggtcgggacagctatgatctggaaatacgggattatcgggacggaaaatggagtcgtcaaccagatcgttcagttttttggaggaaccccaaagaactggtttatgacaggactcccgttgatgatgttcatcatcctttacacgctctgggcggatatcgggtacaacatcgtcctgttttccgccggaatcgagggcgttcccaaggagtttgatgaggcggcggccattgacggggcgggagcaatccggagattcctgtccattaagctgccgctcatgggcagaacatttgcctttgtggcggtaatgacgatggcaaactatttccagatgttcgcccagttcagggtgtttgcgccggacggcggcatgaatgactcggtgatggtactgacaaattatatctataagacaagtttcgtaagttttcatatgggatatgcgtccgcagtggcggcagcgctctttgtcatcgtctttgcggtggcaatgatccagaataaaatgatgcgggcagattggagttatgaataatgaaaaagaaaagaacgtataagccatatcattatcttatcatcatttttcttggaggcctgtctgttgtcatactatacccgcttgtctggatgctgatgacgtcctttaaaacgaatgtggatatccggacaaacagggcgaaattcttcccgactgagtggacacttgaaggataccggacggcctttgagaaagctccgatcgctaactggtttatcaacagtatcctgattacagttatcattaccctggcggtgattgtcaccagcacgctgatgggatatgtgtttgcgaaatatgagttccgtttcaaacgaacgctctttgtgctgcttttggcgaccatgatggtgccgccgcaggtgacgatgattccaagatatctgatgatccagaagctccatcttttcgatacgaggggggcgctgattgtgccggctctggtaagcgcgttctctgtctacctggcaaagcaatttatcgcggatattccggacagcctgtgtgaggcggccaagatcgacggagcgggtccgtttcagatctactggaaggtgattttaccaaacatccggccggctatcggctccattggtatttttacggcgatggcaagctggaatgattacttaaatccgcttctgatgttaaacagtattgataagatgacgctgcctttgggactgatttactttaacagtgacaggacgtccgatctgtcggctacgatggcggcagcggccatgatgatgatgccgatgattgtgattttcattctcttccaaaaacagtttatcaagggaatgacgatgagtggaatcaaataaaagaaaactatggagggaatatcatgataaagcaagaaactgtgtatgagatgagacttgtgagtgcgcttgagaaggtttttctggatgaaagaccggtgtaccggccggagtgtatgaagctgacggcgctgaaaggagagaccgtgtcatttcaggcagcctgtacctgcacttcttttatgaagaaccgggtgaaggtgaggatcgagtcaccgattagtgatcggattcatgtccggaaggtagaaaacgtgcctgcaggcagagtgtgcggaccgattgtggacgacaattatctgaagaccgaatccgggctgtatccggatctgctgcgtgagctcgtagatggggaagtggatattttccctcagaaatggagaagcatttggattgatattgaggttacggaagatgtgaaagccggcctgtatccggttacagtgatcctggaaaaagatggggaaacactggcccgggcagctacggaagtaacgatctatgatgcggtgcttccaaagcagaagatgatgcatacggagtggttctatctggactgtctggcagactactaccatgttccggtgttctcagaggagcactgggagatcattaccaattatctgaaagaatatgtcaaacggggatgcaatatgatcttgacgccgctctttactccggctcttgacacggcggtaggcatagagcggacgacgacccagcttctggacgtgcgggtagaaaacggaaattacagtttcggttttgaccgggtgaagaagtggatcgatctctgccagtcctgcgggatcgaatattttgagatctgccatctcttctcccaatggggagcaaaatacgcgccgaaggtcatggcggtggtgaatggaaaagaggagcagatctttggatggcacaccccggcagtgggcgagtacacgaaattccttcacagccttctgccacagttgactgaaaagctaagagagtggggaattgacaaggtaacatactttcacctttccgacgagccaagagaagaacatctggagagttatcgggcggccaaggaatcgatcgagggattgttggacgggttccataccttcgacgctctttccagttacgaattctacaagcacggtctggtggacaagccgattcctgggaataatgagattgaagaattcctggaacatggcttgacacacatgtggacctactattgcgtgggacagttttacgaggtgagcaaccgcttcatgtccatgccgtccctcagaaaccgaatttatggattgcagctttataagtatcagattatcggtattctgcactggggatataatttctacaacagtcagttttccctggagaagctcaatccgtacgaggtgacagatgccggcggcgcgtttccgtccggggatgctttccttgtttatcctggcaaagaccggcatccggaagagtccatccgtatgatggttcatgcagaagcgcttcaggatctgcgggcgtgtgagcttctggaaactctggcaggcagagagtttgtgatggaatgtatcgaggaagatctggcggaaccgctcacctttaaacggttcccgaaatcggattactacctgcttgcgcttcgcaaccggatcaatcgggagatcgcaaagagaatttagaattgctaatagaatatacaaagtagaatatacgaagatataggatcccaccggaaacatccaggtgggatcctatgtctcagggagaaagagatggttcataagcagttatcgtaatgagaagagcaattcgtcataggttggatatggaagatagcatcccggaatgatggcctcagcctgatccacggcggcacgaagggcgtccatgtcggagagaatgatgtcgtggtagtagcgggcggcagcaagtggctcttccatcttttccgcttgcagtgtgtcggcggacaggtttgaaagcgctgtggcgatctgctcagatgctttggtcagcgtctttatgatttgttcctcataagatgccggaagagacggcagaagctttttcttgtccagtgcctcctttgccacttcggatacataggagaagagcgccggggtaaagtcctttttcaccatatcctgcatggtcagtgattcgatatgaattgtcttagagtagttctccagaatgatttcataccgggagtggatctcttccttggtaaagatctgatgcctggtgaagagatcgatatttttttcggcgataaactgtggcagagcatccggaagagatttcaggttccataagccccgcttttcggcttccgcaacccaagcgtcggtgtagccgtttccgttaaagagaatccgtttatgtttgcggatgagctcttttaagaggtcctcaatggcggtagatctttccgattccgagacgtcttttaaagcatgatatatctgggaaagggactcggccaccgcggtgttgagtaccacatttggtcctgccacagagagagcgcttccaggcatccgaaattcaaacttgtttccggtaaaagcaaacggtgacgtccggttccggtctgtcgtatctttggcgaagtgcgggaggacgtgagcgccgatctccataagtgtctgcttctgtttgagaaaatcgcttccgtcttcgatggatttcaaaacggcggtcagttcatcaccaagaaagatagagacgatggcaggaggcgcctcgttggctccgagacggtgatcgtttccggcacttgccaccgagacgcgcatgagatctgcataatcgtccacggctgcgatgacagccagtaaaaagataagaaactgcgtgttttcggctggggttttacctggatccaacaggttttcccccgcatccgtgacgagagaccagttgttgtgcttgccgcttccgttgacgccttcaaatggcttttcatggagaaggcaggcgagatgatgggaatccgcgatcttcttcatcatctccatggtgagctggttgtggtccacagccacgttggcagtgtcaaagaccggggccaattcgtgctgtgccggagccacttcattgtgcttggtcttgaccggaacgcccagtttccaaagctcttcatcgagatcgtgcatatacgaggctacctttggtttcagtacgccaaaatagtgatcttccatctcctgacctttcggggccggggcgccaaggagggtgcggccacagaagagcaggtcttttctctgcttatagagatttttatccacaagaaaatactcctgctcggatccgatagtcgtatcgatttttttgacgcccttattaccaagaaggtgaaggactttcagcgcctcagcattgagcgcttccatcgaacgaagaagcggcgtctttttatccagcgcctctccactataggagcagaatgctgttggtatatacaaagagccatctttgatgaacgccggagacgttgggtcccaggcggtgtagccgcgagcctcaaaggtcgcccgcagtcctccggatgggaaactggaagcgtctggctctcccttgatgagctcctttccggagaattccataatgatctggccgtctcctgacggggaaataaagctgtcatgcttttctgccgtgaatccggtcatcggctgaaaccagtgcgtaaagtgggtggcaccatgctcgacgtcccattctttcatggcggccgcgacagtattggctacatccagttccagatgggttccgctttgaatggtcttgcggagcgctttgtatgtatcctttgggagacgttcacgcatcactttgtcattgaataccaggcttccataaagttctggtattgtgtttgtcagttctttcatcatagagagacagctcctttcctatcctgaaatcaaaaaaggcactttggaccaaatccaaagcgccattgctttatgcaggtagtataaacacaaactagtggcgctgtcaatccttttttggaaaatagaaatgtctgatgattcacagataggaatcattgaaaaaacatctcttctaatatgacccttgcaaaatcaaaaaagatggttaaaatatcttagtatgaacgggaatcgaacctgttttctgaaaataagagccagaagatggcgagaaaagggatggaggaaaaaagatgaagacaaagacagagtggaatcagagaagggaaacgggagtcggagaagagtgtggtgtatttggtatctacgatatagacggaaaagatgtagcctcctcgatctattatggactctgtgccctccagcataggggacaggagtcctgcggcattgttgtctcagacaccaggggggagcggggaaatatcgcctaccataaggaccaggggctggtcagtgaagtattcaaggcagatatgcttgcgtccctccatggaaatctggggatcgggcatgttcgctactcaactacggggggatctaccagggagaatgcacagccccttgttctcaactatatcaaaggcaccctggctcttgcacacaatggaaatctgatcaatgcacctgaattgaaagaggagctggtctatggaggtgccatcttccacacgaccacggattctgaaatgattgcgtactgcattgccaaggagcgagtgcatacaagaaacgtggaggaggcgatcctttgtacgtccagaaagatccggggcgggtatgcgctggtggtgatgagtcctagaaagcttgtcgctcttcgggatcccttcggattgaaaccgctctgcattggaaagagagggcatgcctacgtcgtagcgtcagaaagctgtgccctggatgcggtaggagcagaatttatccgggatattgagccgggagagatgattgctattacaaaagacggcattatctccaacaaagagctgcagcaggagaaacgagcccattgtatctttgaatacatttattttgcgaggctggacagcaccatggacggcatcgggatctatgacgccagaatacggctggggcgtgctcttgcgaaagcttggccggaggatgccgatttggtaacaggagtgccggagtccgggattactgcggccagaggttttgctatggaaacaggacttccctttgagcttgccttttataaaaacagttatgtcggcagaacgtttatcaagccgactcagaaagagcgaagatccagcgttcggattaagcttaatgtactggagccggtggtgaggggaaaacgcatcgttttggtcgatgattctatcgttcgggggacgactatggcaaacttaatccggatgctcaaggcagcaggagccaaggaagtccatgtgcggatcagcgccccgccgtttctgtatccgtgttattacggcacagatgttccatccaatgatcagctcattgcctcagagcacacgactgaggagatccgcacactcatcggcgcggattcccttggctatatgaagatcgaggatcttcagaccgttgtgggagaccttggaatctgtaaggcatgttttgacaatcaatacccggtttcggaagggaaggaaagtcggatcggataaaaaataaaaaagggatttacaaaaagtaaaaaacagagtatagtattggaataataaaaatgaaggaaacgaaaaggcggcaaaggtgtcggtcaggaaacgcggaaaaagcgatttccagacacttttgccccttttttatgttttgggagttttagagcagcaaaaaggaggaaagacaagcaatggtaaactatgtttttgtaacaggaggagtagtatccggtcttggaaaagggattacggcggcgtctctggggagacttctcaaggcgaggggctatcaggtcacgatgcagaaatttgatccgtatattaacgtggatccagggacgatgaacccgatccagcacggggaggtatttgtgacagatgatggtacggagacagatttggatctgggacactacgaacggttcattgatgaaagcctggacaagaactccaatgtcacctccggaaagatttactggtcggtgttaaataaggagcgacacggagactacggcgggggcacggttcaggtaataccgcatattacgaatgagattaaggagaggttctaccgggcgaaaaatccaggagaggagaggatcgcgattatcgaggtgggcggcaccgtcggagatatcgagagccagccgtttctggaagccattcggcagtttcagcatgatgtagggaaggagcatgccatcctcatccatgtaacgctgattccttatctgaaagcatctggcgagatgaagacgaaaccaacacaggcaagtgtcaaggaattgcaacgcctgggactttggcctgacatcctcgtatgccggtctgaatacccggtacctctggagatgaaagataagatcgcacttttctgtaatgtgccgtcagaacatgtcctgcagaatctggatgtagagtatctttatgaggcgccccttgctatggagcgggagaacctggcacaggcagttttaaactgtctgcatctggaacaaagggaaccggatctgagtgactggattgagatgacggaggcacttaagaatccgaaacaggaagccgagatcgccatcgtcgggaaatatacccagcttcacgatgcatacttaagtgtagtggaagcattgaagcatggaggtatcagttgccatacggatatccgtttccgatggacggattcggagacgattacggaagaaaatgtggaggagacattttgtggcgtggatggaattctcgtgccgggagggtttgggagacggggcacagaaggcatgattctggcggcagagtatgcaagacgggagaaaatcccatatcttggaatctgcttgggaatgcagatggctatcgtggccttcgcccggtttgtcgtgggatatcacgatgcgggcagtatcgagtttcagccggagaccatgcatccggttatcgctttgatgccggatcaaaaagatgtggaaaatatcgggggcactctgaggcttggggcatatccgtgtgtactggatgaagattcccggtgctttgccctttatggaaagagggagatctccgagagacacagacaccgctatgaggtcaataacgattaccggagcgtcctggaagaagcagggatgcacctggcggggctgtccccggatcagaggatcgtggaaatgatagagattacggatcatccgttttatattggtactcaggcacatccggaatttaagtcgaggccgaaccggccgcaccctctttttgccgggtttgtaaaagcggcgtctgagcaccggaattagaatgaaaacgaaaggaagagagcgatgaaaggaaataagggactttactgtccgatgctggagcatgacaactgtggaatcggcgcagtcgtaaatatcaaaggaaaaaagacacatcaggttgtgagtcaggcgcttgagatcgtggagaatctggagcaccgtgcaggaaaggacgctgagggaaagaccggggacggagtcgggattttactacagatttcccatcgttttttcaaaaaggtgtgcctaaaagagcagattctcattggagacgaccgggaatacggaatcgggatgtttttctttccggcagacgaacttacgagaaaccagtcacggaagatgtttgagacgatcgtggcaaaagaggggctccgctttcttgggtggaggaaagtaccggtgcacgaggatgtactcggcaagaaagccagagactgtatgccgtatattatgcagggatttattgaaaagccctcggatactgcaaaagggctggaatttgaccggagactctatgccattcgccgggaatttgagcagagcagtacagagacgtacattgtttctctatccggcagaacgattgtctataaaggcatgtttctagtcggacaactacgtacattttttgaggatcttcaggatccggattatcagaccgcgatcgccatggtacactcaagatttagtacaaacacagagccaagctggaaccgggcgcatccgaaccgtttcatcgttcacaacggggagatcaatacgatccagggaaatgcggataagatgctcgcaagagaagagagaatggtttctccgtatttttcagggagtcttgacaagatattcccagtggtggatcagagcggttcagattctgccatgctggataatactttggaatttcttgtgatgaatggaatggatctgcctcttgcagtgacgtgtgtgattccggaaccatgggagaatcatgataccctgagccagaaaaaacgggatttctatcagtactatgcaaccatgatggaaccttgggacggtccggcgtccgtgcttttcagtgacggtgatatcctgggggcagtgctggaccggaacggtctgcgtccgtccaggtactacatcacccgggacggctatctctatctgtcatccgaagtgggagtacttcagggaatccgggaagaacagatcctggaaaaaggaaggattcatccgggaaagatgctggtggcggatactgtgagacaaaaaattctgacagatgatgaaatcaaagagacttatgcgtccagacagccttacggggaatggctggatcaacatatgatggaattaaaagatctcaagatcccgaacaaaaaggtggagcagtatacgaaggaagagtgcgcaaggcttaggaaagcatttggatattcctacgaggagtaccacgattccatccgtacgatggcattaaacggtacggaagggattacgtccatgggtgtggataccccgcttgcggcgctttccaacaagcagccattgctattctcctattttaagcaacggtttgcccaggtgacgaaccctccgattgacgcagtgcgggagaagattgtcactaacaccagtgtgtacatcggaaaagaaggcaacattttaaaagaacagccagaaaattgccaggtactgaaggtcaacaatccgattctgtcagatacggatcttctgaaaatcaagggcgtgagacagccggggctgtacccggcggaggtaatgatcacctgtatgaaacatatgtctctgaagatagcgctggagcgtcttttcatcgaggtggaccgggtttataaggacggggcgtccatcttgattcttacggatcggggtgtagatgagactcatgtagcaatcccatcgttgctggcggtctccgccgtccatcactaccttgtccggacgaaaaagagtacggttatgccgatcatcctagagtcggcagagccaagggaagtccatcattttgcaacgctccttggatatggggcgagcgcggtcaacccgtatctggctcacgagacgatccgggagatggttgaggatggcttgctggaaaaagactattatgcggcggtccatgattatgataaggccatcttaggcggaatcgtcaagattgcgtccaagatgggcatctccacgatccaatcttaccagggttcccagatcttcgaggcggtgggcatctccaaagaggtcattgatccgtattttacccacaccctcagccgggtgggcgggattaccatgaaagagatagaggaggatgtggaactgcgtcacagtcaggcatttgatccattgggacgaaagacggatcttacattggagagtgtggggcggcatagttttcgcagtcagggagagcatcaccggtacaatccggcgacgattcacctcctccagcagtccgtctggcaggacgattacacaatgtttcaggagtatacaggacagattgataaagaggaaaccggatatttgagaagtctcatggacttccgatatccgaaggaaggcgttcccatcgaagaggtagaaagtgtagattccattgtaaggcgatttaagaccggagccatgtcctacggttctatttctcaggaagcccacgaagcgctggcggtcgctatgaataagatacacgggaaatccaacagcggagagggaggtgagtccccggagcgtctactgacaaaagggacgaaggacgatcgctgttctgccatcaagcaggtggcaagcggacgttttggtgtcaccagccgttatctggcaagcgccgaagagattcaaatcaagatggctcagggggcaaagccgggagaaggaggccacctgccgggaaagaaagtgtatccgtggattgcaaaaactcggtattctactccaggcgtgagtctgatttccccgccgccacaccatgacatctattctattgaggatttggcgcagttgatttacgatctgaaaaacgcaaatccaaatgcacggatttctgtgaagctggtgtcagaggccggggtaggtacgattgcggctggtgtggcaaaggcaggagctcaggtggtcctgatctccgggtacgacggaggcaccggagccgcaccgggaagttccattcacaatgccggactcccgtgggagctgggccttgccgaggcgcatcagacacttctgaaaaacggactgagaaacaaagttcggatagagacggacggaaagctgatgagcggccgggacgtagccgtcgcagctctcctgggagcagaggaatttggatttgcgacggctccgctggtagcccttggctgtgtgatgatgcgggtctgcaatcaggacacctgtccgatgggagtggcaacacaaaatccagaacttcggaaatgtttcaaaggaaaaccagaatatgtgattcatttcatgcggtttatcgcccgggaactccgggaatatatggcgaagcttggtgtaaggacgatagatgagatggtagggcgcaccgatcttctgaaagtgcgggaaaatccacaaagcaaaagaggaaggatgatagaccttggagctatcctgaattcgccgtatatggggaaaggcaatctcaaaggggagtatgagtttggactttccgggacactggatcagacggttctcatcaaagaactgcaagaaaagctggatgccggagaacctggcaagatacaggttcacgtcaaaaatacggaccggacgtttggaacgatgtttggatccgaacttacgagacgatatccggaaggggtgcaggaagatacgtatcagatagcatgtacaggaaacggagggcagagttttggagctttcatcccggcaggactgacgatccgcctggatggagactgtaacgactactttggaaaaggactttccggggggaaacttgtcatccggccgcccaagggaggtacctaccgggcagaggacaatatgattatcggaaatgttgctctttatggggcgactgacggaaaagcctttatctgcggactggcaggagagcgtttcggcgtgcggaattcgggagctacagcggttgtggaaggcgtgggagaccacggatgcgagtatatgacaggcggcagaatcgctgtcatcggtaagaccgggaagaactttgcggccggcatgagcggcggaatcgcctacgtgttggacgagtggaattctctctaccgtaacatcaacaaggagatgatttctatggaggaaatcacgcagaagggggatgcggacgaattgcgagccatgatcgaggaacatgtacgggagaccgggtcccggaaaggacaggagattctggagcagtttacgaaatatctgtcgaaatttaaaaagatcattccaaatgattataaaaagatgctgacactaagcagaaagtatgaagcgatggggtttgacagcgaggaggcgcagattgaggcgttctacgagagcgtaggtcagaaaagacaggagggataaaaacaacatgggaaaaccgacaggatttttagaatatgaaagacggacgggaagtgaacgcccctgcaaggagcggatcggagatttccatgaattccatgagccgctcccgccagaagtacaaaaagagcagggggcaagatgcatgggatgcggagtgccgttctgtcagtttggaggaatgattggtacaatggcgtccggatgcccgttaaataacctggtgccagagtggaatgatcttttgtaccacgggcagtatgaagccgcctatcagcgattgcaaaagaccaactgtttcccggaatttacatcccgggtctgtccggcgctctgtgaggcggcatgtacctgcaacgtaaacatggatccggtaacaacgaaagaaaatgagcgtgcgattatcgactgggcctttgcaaaagggatgataaagccccagccaccggaaaaccgcaccggaaagcgtgtagcggtgatcggaagcggacctgccggacttacggcggcgctgcttttgaaccgccaaggacacagtgtgactgtctttgaacggaaggacaggatcggaggactgctgatgtacggcatcccgaatatgaagttagagaaaagctcgattgagcgaaggaaagcacttatggaggaggaaggtgttgttttttgtacaaacatcgatgcgggccgggacaaagaggcagcggagattctggacacttttgaccgggtgctgcttgcctgtggcgcctccagaccaagggatattaaggttccgggaagagacgccggggggatccgctttgcggtggattttctttcggaagtgacaaagacgcttctggattccggatttgccaccgtcccatctgagcttgcaaaaggaaaacatgtcgtcattattggcggcggagatacaggaaatgactgtgtgggaacctccctgcgtttacaggcgaagtctgtgacccagttagagatgatgcccaagccgccaaaagaacgggatgggaacaatccgtggccggagtggccgagggtggaaaagaccgattatgggcagcaagagaggattgctctgacgggaaaagatccaagatgctaccagacgacagtaaaggaatttctgaaaaataaggaagggaatgtgcgtgctattcggacgatccggttagaacagaagaaaaacgagaaaaccgggcggatggagatgcagccggtgaaaggaagcgaggaaacgattccggcagatctggtgctgattgcggcaggatttaccggagcggaagattacgtcatagatgctttccaggttaaaacgtccggacgaggaacggtagaggatcaggactttgcggccagtgttcctcgtgtatttgtggcaggtgatatgagacgggggcaatcccttgtggtctgggcgatccgggaaggccgggaagcggcaagggagatcgaccgttctctcatgggctacacgaatctttcctgaatagaatcagaaggatgggacagtacgaaagaacagaggaaaagatcggacatagttcttgccctttcttccggatgcggaatataataagtacatcagggaatcgacgcaatcgaaagatggaggaaatcaagatggcaaaatatgagacatgggaaattctacagatgatggaagaggaagatgtaaaatttatccgtatgcaatttgtagatatcttcgggacgatccgcaatatcgccgtgactgccggacagatggaaaaggcgctgactggaaagtgtatggtagacggctacagtattgccgggatgaaagacatgggatatgacaaggtctgcttaaaaccggacctcgatacgttcacggtactgccgtggagaccgcagcagggaaaagtggcgcggtttctctgtgatctgatggatcaggagggacgagagattccagaaagttccagatacatcctgaaaaaagtgatggatgaggcagggcaggagggatacagctttgatctggatccggagtgcgaattttttctgtttgagactgacgaagagggcaatccgacaacgaggacaagggagaaagccgggtacctcgatgtggcgcctcttgaccagggagaaaacgcaagaagagatatgattctgacactggaggagatgggatttgaaatcgaatcctcccatcacgaggacgcgccggcccagcatgaggtagactttaaacaggcccggggcgtcaaggtggcggatcagattgtaacctttcgttccacagtacgtaccatagcccagagacacggcctgcacgcaactttcatgcccaagccacggacagatcttccgggctcggccctgtcgctaaatatttccggattccggaatgggaggagtctctttgcggatcaggaaatggaaaatggactaagccgggaggcatactcctttattgcggggcttttgactcatatgaacggaatggcggcgttttccaatccgattatcaattcgtataagcggctgaaaccgggatttcacgcgcctacagagctattctggtcgctcaatgactaccgggctccgatccgtgtggtgacgggaagagaggatgagattcatatggaatggactctgccggacggcgcggcgaatccgtatctgctcattgcactggtggtgtccgccggtttaaacgggattcgtgaaaggatggttccgttaaaagcggatgaaaaggccggaaagcttccggggacattaaaggaatctctggatgcactggaacaagatgcgtttttaaaacaggtgtgtggagaacgatatgtggaaacctatttaaaggaaaaaagaaaggaatgggagctctatacgcgggaagtcacagactgggaacttaaggagtatctgcacagattttaacagatggcagggggaggatatatgggaagtattatcatcgcacttccacggaaggataccgcgggaaaaatcaaagaaatacttctgcaccatggcttccgggatgtggtggttgtgcctacggcggctgcggcactccaggaaaccgggcgtttatcccacggaattatcatcagtggaacaaagctttctgatatggattatacggatttgctggactgcctgccgcgttattttgatctgctgcttttggatacaacacagaatgtcagttacagaagacagccgggactgattgcagtgacgatgccggtgagagttctggagtttgtcgatacagtcaatatgatgcttcagaatctggaccgtcaggtggtgaaacgcaagggcaaaaagccaaggcgcacggagaaagaggagaactatatccgaaacgccaagtctgtcctcatggagcgcaaccatatgacggaggaagaagctttccgctatatccagaagagcagcatggacacggggaggaatatgacagagacggcacagatgattctaaccctgatatataatgagatttgaggacaaataaaaacgagagacgaaaaccaaccgtgcatcgcgtatgtacgaatggttttacgtctctcgtttgttcattgacgatgaaggcaaatcaagataaaataaaagaaatcaagaagaacgaggcagaagaatgaaacgaatcaaagacaatgacaatgcgacgattgtcgcatgttacatcggatatattacccaggccattgtcaataattttgtccccctgctgtttgtgacctttcaaaagcagttcgggattgcgctggataagattggattgttaatctccgtcaattttggggtccagcttctggtggatcttctggcggccggactggtggagaaggtcggagagagaaaaacgatgattacagcccatctatgcagtgggacaggacttttactgcttgcctttttgccgtggctgtttccagttccatatatcgggcttctgatcggaattgtctgctatgccatcggaggagggctgatagaagtaatgttaagtccgattgtggaggcgtgcccgacaaagaacaaggaggcggtgatgagctcgctgcactctttttactgctggggacatgtgggagtggtactgatcagtaccctgtattttgcagtattcgggaccggatcctggtggattttggcctgtatctgggcagttattcccttttttaatacctgcctcttttttcatgtgccgatccgttccctcgtggaggagggaaagagcatggggcttcgtgagatctttagggaaagggtattttggattttatttatcgtgatggtctgtgcgggagcagcggagcagggcatgagccagtgggcaagcgcctttgcggaaatgggactttctgtcagcaagacagtaggggatctggcggggccgtgtatgtttgcggcctgtatgggtgcggcaagagcctggtatggggcgttttcagagaagatccggctccataattttatgatgataagcggcctgctctgtgtggcggcctacctgctggcaggcctgtcaaaaagccctgtactgggactggcaggctgtgccctgtgcgggctttcggtcggaattatgtggcctggaagttttagtaccgcggcaaaagtattaagaaggggcggtaccatcatgtttgctttccttgcattggcaggggacctgggatgctctgcgggacctggtcttgtaggaatgatctcagaactttctggaaggggactgaaagcaggacttttttcagcaatcgtatttccggtgattcttgttgccggaatctggatgataaaacaagaaaacaggaggtagaagagagtgaaacaatatattatggcgctggatgcggggacgacgagtaaccgttgtattctgtttgaccgtgcgggaaagattgtcagtcttgcacagaaagaatttacccagtattttccgaagccgggatgggtagaacacgacgcggacgagatctggtcgactcagcttggtgtggcagtagaggccatgagtaagatcggggtgtcggcggatgatattgctgccattggcatcaccaatcagagagagacagccatcgtatgggacaaggagaccggagttccggtgtgtcatgcgatcgtatggcagtgcagaaggacagccaaatactgcgacagtttaaaagagcgggggctggaagagtggttcaggatgaaaaccggactgaccattgacgcctactttgcgggtacgaaagtgcgttggattctggaacatgtagaaggagcaaaagaacgggctaagagaggggaactgctttttggtacggtggagacgtggctcatctggaaactgacaaagggaaaagtccacgcgacggattactccaatgcctccaggacgatgatgttcaatatcaatacacttcagtgggatgacgagattttggaagtcttagacatcccgaaatgtatgcttccggaagtccggccgtcgagctgtatttacggaacgacgtccccggcatattttggcggggaaattccgattggaggagcggcaggggatcagcaggcggcgctttttggacagacctgcttttctccgggagaagcaaagaacacgtacgggacaggctgttttctgttgatgaatacgggggagaccccggtattttcgaaaaacggacttgttacgaccattgcctggggaatggacggtaaggtgcagtacgccttggaaggatcgattttcgtggcgggggctgcgatccagtggcttcgggatgagatgcggctgattgattcggcggcggactctgaatatatggcgcagaaagtgccggatacaaacggctgttatgtggttcctgcctttaccggtcttggcgctccgtactgggatcagtatgcacgaggcgccatcgtcggcatcacacggggcgtcaataagtgtcacatcatccgggcgacactggagtctttggcctatcaggttcacgatgtcatccgtgccatggaggcggactccggtatcacactgacttcgctcaaagtggacggcggggcaagtgccaatgattttctgatgcaggtgcaggctgattttgatgccgctccggtgcggcgtccggcatgtgtggagacgacggccatgggtgcggcttatttggcaggacttgcggcgggcgtctggaagaacaccgaagaaatccgggcaaactggaagattgaccgggaattcaccccggcgcttcctgaggagaagcgtcaggagaagatgaaaggctggaagaaagcagtgcgctatgcatttgactgggcaaaagaagaatagagtgcatagccgaactgttacaataaaattgacgaaaaaagtgaaaaatgatagacaattatgtacaaatatactaaaatagacgtattggattaagacgaatacggaggtagggatatgaaaggaaatgtaattgtaggacagtccggaggaccgacagcggcgatcaattccagtctggccggtgtctatcgtacggcaaaggacagaggagcaaagaaagtgtacggaatgcttcacgggattcagggactgatggaggagaaatatattgatctgtcagagcacattacaaacgatctggatgcggagcttttaaagaggactccggcggcatacttggggtcttgccgttataaactgccggagatccatgagaaccgggaagtgtatgagaagatttttgagattctggataagctggatattgaggcgtttatctatatcggaggcaatgactctatggatacgatcaaaaagctttccgactatgcgattgtgatgggatatccgacccgttttatcggatgcccgaagaccattgataatgatctggcactgacagaccatacaccgggatacggaagtgcggcgaaatatattggaacatctgtaaaagagattatccgcgacagtttttgccttgagtacagcaaaggactggtgaccatcgtggagattatgggaagaaacgcaggatggcttaccggagcggctgcccttgcaaagggagaagactgtgcgggaccggacctgatttatcttccggagctgacttttgatctggacaatttcatggagcggatccgggagcttctggcgaagaaaccgtctgtagtggtagcagtttccgagggaattcatctggaagacggacggtatgtctgtgagctgggtgcaaacgtggacttcgtagatgcttttggacataaacagttgaccggaacagcagcgtaccttgcacactatgtggccaatgaaatcggatgcaagacccgtgccattgagctgagtaccttgcagagatcggcatcccactgtgcgtccagagtcgatattctggaggcgtcccaggtaggaggagcggctgtgaaggcagccgacgagggagataacggaaagatggtcgtactcaagagaatttccgacgatccatatcagtgcagcacggaagtgaaggatgtacataagattgcaaacgacgaaaagcttgttccaagagaatgggtcaatgcagaaggaacctatgtgacagatgagtttattgcctatataaaaccactgatccagggagacgtttctccggttatggtggacggaattccgagacacctgtataagccaagccactagaatcatgaaaaatagaaagagggaatcaaaattgaagatcggcgtgacaggagcagatggatttctgggcagcaggattctccggttctacgcaaggaaatatgagataaagggatatcaccatacggacatggatttcactgatcctgaggagacggaaacaatgctgaaacgggactgcccggatatcctgattcatacggctgctatctcagatgtgggagcctgtgagcagaacccggagcactcagagctggtgaatgtggacggagtccggaatctggcggttatctgtcagaagattggttcaagattccttttttgcagctcagatcaggtctacacgggaaacggagtgaaagagccgcaccgggaggaagaggcgctttccccgctcaatgtgtacggaagacagaaagtccgtgcggaagaggaggccattcaggtacatccggatacggtggcacttcggttaagctggatgtttgctgctgacttccgggaaggaaaggaacatgggaatctgattcccgcgattttacatgctgtacggtcaggacagcatgtaaaatacccggtttgggattaccgcagtatcacggatgtgtgggaagtcgtagcaaatctggaacagatgtttgatgctcctgccggcatttacaatttcggtagtgaaaatgacaagagcacctatgaggtggtaagcaacttcctggagagcgccggaatcccgaactcgatgctggaaaggaacgaagaggcattcagggaatgtccgagaaacttaagaatggagaccgaaaaggcaaagtacctgggtgttcacttcctgacgactgaggaagcactcagaaagcttggagctgaattgggatacgaagggaacgaccctaagaagaaaagagaatagagaacgatagccccctgcgccggcaatgtatgatattgtcggatgacagggggcgttttgttttgataggctcatgtactactaacccgtttccaagcaaaatcagatggacgttttccgaaagcacaggacagcagcagcgacgttgaaaaccgtgagcagtaccgtaattacaatggctggcaggaagtgactgcaatcagtagttccggtcagaagatccatttgtccaagaagaagggttggaacataatcgctcacggccgggaaaaacccggcaaagtaggagatcccgaagcaagcagcacagaccagaagaactgccgaaactgaccggcagaagaccgaagccccgacgaggacagagatcatccacactcccagaagatagaaggcaagcagggagaacgccaggttctgaatgatgctgttgtcccagaagtagacggtgtaggcaaaggtgatgccaaagctgatcagacacccaaatgtccagatcagaagcagggcaaagtatttcggcagcaggatgttgtggcgtttcaatcctttggacagaagaataatcagtgttccatgctggtattctgaagtcaggataccgccgtataaaatcagaaagacaaaaagaatgatctgcatatttttatagtactgtgtccaggaggagagagaagtcacctccagattgccgatctggataccggtctctgccatatcgccggacacgagatccaaaagccacggtgtcatcttagcaaaggccggactgagcacgcccacaagggtgaacaaaagcaacatgacaacgagacgatgggtctttaactgctcaaagagttcttttttcatcatggcacggagctgtctcatgttctaccacctccaaaaataaatcttccaatgtcggctccagcttttccagcttttgcactggcacttgtctggagacaaggtcagccattacagatggcatggtgatgtcagcgcgtttcgggagtatgattgtgagtgcgtctgtctgcaggctttccgggtacttcttcaggcaggcttctgcatcagaacgacgttcaaattcgatttggattttttccccgttgcctttccgtttgagattctccagcgtcccctggacgacgatgctgccgtcgtgcagcaaggcaacgtggtcacagatccgctccacatctgataacacgtgggtggagaaaagcaccgtcgtctcctcagtgacagaagagagaatatccagtatttcctttcgacctaccggatcgagagccgaagtcggctcgtcgcagatcagaagctttggggcgttcaaaagagcctgggcgataccaagccgctgtttcatcccacgggagtaggtgtggatatgtttcttactgtctgtaagacctacaagatccagaagatccaggatgcgccgtctgacatctgaggactgcataccggtgatctcaccgcacagcgtcagatactgagaggcagtcataaagccataatattccggaacatccggaagatagccaatataacggttcgtctggttttcgccaaaagatacccgttcaccgttgacttggatttcgccatggtccggctttagaagccctacaatcatccgcatggttgtcgtcttcccggcaccatttttcccaataaagccaaagacagaatgcgctggaacggacagatgaagatgatcaattactgtgcgggaaccgaaagattttgtgagatctcggattgataaaatatccatgcttattcgtcctccttcccgaatacaaagtacagcacgggtccgatgaactgcatcccgacaatagcaatgatacaccacatcagccgggtaccgcgtttataatgcgtgtgtgtgaagatatgccataaggtataaaagagcaatactagttccacaatggcaagtggaatgaaaaaaggcagcatttcctgtaaactcattcaatcatctcctttaattgattctgaagtctccgaaacgtgttgtcatcttttagtttttcaaaaagcggatgggacagggaagcagcaatgtcttttacgaatgtttttctcgcccggggagagacagagccgtttgcaagctgttcgatccagtgatcaatccggttaaagtagcggtcaccatgaaggcgatactcttcgtctgacaaaagcgtgcggattccgtccaggtatttccgggtatgggtaagagcggcatcgggatcgtcaaactgcagatatccaagcgctgcctggtactcaaaaacggagacagcattggcattgagttttacaagctgatagctgtcgatcaaagactccacccgctccaccgtcatgtcaaaagcattctgatcacttgccgccacggttagatacttagcggaaagctctaccagggagaacagattcagatacatcgtgatctgggcaaagtcacatgccttttccctgtctccgttcatcaaataggcggagacgaggacgctgtcactttctctggaaagtgttctgggatcagagtccgcttccagtatctggagcgcttccttatattgtcctccacccatgagaatgagcgcttttagaatcaaggtatccttgcacagattgagatctgcacagtgtgcgatgatatggtcgcacaaatcgctcatataatgtaaaagctctgtctgtaatttttgtgttttggcaagtaaataatgattcaacaaaaggacacacatctgaaagacaaggggataacaagaataatagtgcttcacagtagtccggatgtcctctaccgttttatcaaaatctgatacggcaaaggaattggaatagtccagatacagcttctggatctgatccttggaaagctgaggcaggtatccaagcagttcatcgatggtaacaccgaaaaacgtggcgagaaccggaatcgtttggagatccggtttgctgatattcttctcccatttagagacagagccttttgtgacgccaatatagtccgccagctcctcctgcgtaattttgcgctcatggcgaagccggattaagttttccgcaatccgcaattcatgcattgttttcacctcctactatgattataagagagagactgggaagattcaatggaattgaacgacactttaagaagaaaagtttaccaataagaaactttttgaatttggaaagcggagtaaatggaaatcggatctgactgaaatgtagagaaaatcccactggcttttaagagccagggggatcagtttctttcgtatataatgaaagtaattatgaaaatgctcatagacagggaggatgccgggtgaccatcggctgatccccggcatttattatgaaaaagtttattcaaaaagtatttacttgacagcgtatttatcaaatctgtttcgtgttccttttgatgattttagtatacccacaattcgtgaaaaaatagtgttctacaaatgaaactttcaataacaaaaaatgaacaaaatatgaatactaagttcgcgttgttcaggttgtacatttatttgccgtttcggaaagcgaaatatggcagaccgtctttctgtggcacttccacctgtccctggatgagcggacgggcatagttgaggaaggcttctgtcacatcggaaccgtctggggtgatccagtctgccggtacggtcttttcctcgttgcagatctttgtgacatcggcggttccaggtgtcatctcataagagtctccttctttccgctcaaatgtaatcatcactcctgtcgctccttccattgcacgctctacgccgtaggaacctgcaagaatggcctcctgaagatctgtccgggacagacaggcagaagagcagcgttgagaaacattgagttccacggagcgcactttgatgccgagtgtttcttttacgaggttttccaggtatttaccggatccggtcagcattttgtgaccaaaggtatcggtacctacatcatttgcatactcgcaaatgaatgttccggtattgtcgtggattccttcagagatacatacaacaagattcgtggtggtctccagtgcccttcgtacctgtgcaaggaaggtttccggatgaaaggcagtctccggcagataaatcagcaccggattgtcacccttaaacattcgtgccagggcggatgccgcggtgagccatccggcatgacggcccatgatttcaacgatggtgacggacggtttgttgtcatagacggatgcgtcgacggcaatctcgcggacggtagaagctacatacttggcggcgcttccaaagccaggggtgtgatctgtcattaccaggtcattatcgatggtctttgggattccgataaagcggatcgggctttcatgctgcgcggcgtagcgggagagcttgctgactgtgtccatagagtcattacctccgatataaaagacggcctcgatttcgtgctcttcaaatctggtgaaaagttccggatacaccggatccgccagatcctccggaagcttatagcggcaggatccaaggtaagcccccggggtcgtctttacaagcggaagggttccgtcttttatcagcgtctgcatgtccatcatctgtccgtgcaggaatccttcgattccatttaccatgccgtagacatgatcgatctgcggcatctcaaagccttttgttataacgccgtagagacttccgttgattacggccgttggcccgccggactgtcctaccaggatatttttactcatgattcagttcctccagttgattcgattttgcttttagtataacgaaaaaagaaacgatgcacaatagaagaaatggaggacttgaaaaatatgcttggaaaatcagagaaaagcgattatactgtaaacagtaactgcaaacgcaggaacgggggaaaacaatgaagtatattacatttgcaataccatgttataattcacaagattatatggagcgggcagtcgagtccgtactcaaaggaggaaaggacgtcgagatcatcattgtcaatgatggatctaaggacgggactgaggagatcgggaaacgctacgagcgggaatacccggatattgtgcgggtgatcagccaggagaacggcggacacggtgaagcggtcaataccggacttctccatgctacagggaaatattttaaggtggtggacagtgacgattggctggatgaggaggctctgattcaggttttaaaccaaatgaaatctttcgaggagaaggatgaagaagtcgatatgttcatctccaactatgtctatgagaaagtaggggcaggacacaagaaggtgattcactacagaaactgtctgccgcaggagcggatttttggctggaatgatctgggacatttccgagtggatcagtatattctgatgcattctgttatctaccggacggagcttttaaagctttgtcagctccggctgccaaaacatacattttatgtggataacatttatgtttactatccgctgcctcatgtcagcacgatctattatctggacgtgaatctgtaccggtattacatcggaagggacgaccaatcggtcaacgagaagaatatgatcaaacggattgatcagcagctttttgtgaataagacgatgattgagatgtatgagatgcggatgattccaaacaagaagctgagaaactatatgataaaatatctggcgattatgatgacggtttcttccatcatctgtattcgttccaagaaagaggaaaatctggaaaagaaaaaggaactctggatctacctcaagaagaaggattaccggacgtacttcaagattcgttatggcatccttggacagacgatgaacttaccgggtaagccgggaagaaagatctcgtccatgggatactccgtgatgaggcggattatcggatttaactaaatatgaataaaagaacggccatggtgcatactactcaataaaagattgagaaagagaggtatgcaccatggccgttgaatttgcacagagccagacaaaagagaacctgatgagagcctttgcaggggaaagtcaggcgagaaaccgttacacaatcgcggcagaggaagcctgtcggaaagggttttacgcacttagagaggttttcctctttacagcggatcaggagagagctcatgccgcaagattttatgagctcctgaaatcggaagcgggttgtaccatccagatcgacggaggatacccggtggaccagtcagagagtctggtggagcttttaaagatggcagcccacaatgaggaggaagagcataaggatgtgtacccggcttttgagaagattgctgaggaggaaggattttctgaggcggcttatgccttttcccagattgcaaagattgagagaatccacggggaacgcttcgcaaaacttgcacagatgcttcagcaggagacgtactatgaacaggaagccggcggagagtggatgtgtctgaactgcggatatatctttaaaggcgcgaaggtgcctccggtctgtccggtgtgccgccacgagaggggctatttcatcccggcctgtatggcaccgtatcttggattttctaattgtaactaagggaaagaaaggggaatgagatggcaagccagaaaatcgaaaatgtgctgaatttggcactggacgcaacacaggaggagcggcttcgctccggcaatctcgaggtggggtacgatgaggcggacaatacatgggatgtcattatcctgtattccgggacactggattcggtggaccggattgcgatggatgtcatcccactgttgaaaaattttgcggttgtaaggatacgggaggaagatctggaagaattggcttcgttagaggaagtcatctatatcgaaaaaccgaagaggctgttttttgaggtagcaaacggaagaagggtgtcttgcatcgacgcggtgcagacaccacgtttgcgtctgacgggaaagggtgtgctgatcgggatcattgattctggcattgaatattccaatgcggattttcaaaacgaggacggaacgacgagaattcgtttcctatgggatcagacggtggagggcagcccgcctgcaggataccggaacgggacagagttttcggcggaagagatcaacgaagcgctccgacagcccaaccggacgatgcagctacaaagggtgccaagccttgatacctcaggacacggaaccgccgtggcaggggtggcagcgggaaatggcagaaacagcaaagggcagtaccggggtgtggcaccggatggggaactgatcgtcgtcaaactgggaaatccgggcggcattggtttccctaggacggcagagctgatgcaggcggtggactatatcgtaaagaaagcagaggaacttcggatgccggtgtccatcaatatcagtttcggaaatacatacggatctcataatggcacctccctgccggagcggtttctggacgcggcggcagagacgggtcgaacactcatcagcgtaggaacgggaaacgagggagctgaggctggtcatgcgtcggggtttctaagagagggagaggagcggaacattcctttggcggtgcaggagcggcagggggcatttagccttcagatctggacggattatacagatgtcattggagtggcccttcagactccttccggggagaaagtcggtcccatccgggaagtgatggggacgcagcggttccgggtcgggaaaacagagcttcttctttactatggggagccaagtccatacagtggactcaatgagatttacatggagtttctgccggcggatgattatgtcaacagtggggagtggaatattatcctgattccggaacagattgtcaccggacagtacgagatgtggcttccggtgagctatgtcctcaatgaaggtacagccttcttctatccgacggaggagcggacgctcaccatcccttctacttcctcccgggtgttgactgtaggggcttacgatgccacagccatgacatacgcggatttctccggacgggggaaagaaaacaaggacaatcagaaacccgatcttgccgcgcccggagtcaatgtcatctccgtccagggacagggcgggtacgctgcttttacaggaacctcctttgccacaccatttgcggcaggcggagcggctcttttgatggaatggggaatgatagaaaaaaacgatccgtttttatatggagagaaggctaaagcatacttaagaaggggggcgagacagcttccgggctttgaagtctggcctaacaatcagctcggatacggggcgctttgtgtgcgggacagcatcccggagacaaggctttcgtgattgtaaacactttttgccaggtgtttttaagcataatgcataaaaagttctctgataagaaaaaaatattatctgttttgatacctcctgtaggattttgaaactcataggttatatttataaccagaaagaaaaagaggacgaaaatctataagacgcagttaaaggaggaaacaatatgatcactatcttgtcaggagttgggatgcttctgcttacgctggcaatcttctcccttttcagtatgaaaatgccaaaaggatctcttgcaatgagcggaatggcaaacgcagcggtggcaacattccttgtggaggctattcataagtatatttcaggagacctgtttggaatttcctttttcagaaccgtaggtgaaaacgcaggaggctttggcggcgtggctgcagcgattgcggtgccgctcagcatgggtacaaatccagttctggccattgcgtcaggcgttgtattaggacagttcggaattttgcctggatttatcgcgggatatgtagtcggattgatttctcaggtaattgagaaatacctcccggagggcgttgatgtgatcgcaggagccctgattgtagctccgctttctctggcagtggcgacagcggctgatccgcttgtgaatatgacacttgcaaagatcggcggcacgattacagcggcggcagagcaatctccgcttgttatgggattcctgcttggaggaattatgaagatgatttgtacctccccgctcagttccatggcgctgacagcgatgatcgggctggacgggctggcgatgggaatcgcggcgatcgcttgtgtgggtggatccttcacaaacggtatcgtattccaccgtctgaaacttggagataagagtaatgtcattgcggttatgatggagcctctgacacaggcaccgatcatcacggcaaatccgattccgatttacggttccaatttctttggaggagggctggccggagtgtcggcggcggtattccacatcatcaataatgcaccaggtacagcgtcaccgattccgggacttttggctccatttgcatttaacaacccgatgaatgttgtattggcagtcgtatttgccgcaatcggcggaacccttgcaggacttgtgggaagccagattttcaagaaacattacgaaaagaaagcagcaggaagagaaaacagccagatggcagaagttgcgatggctgattcatagaatagaagaaagcctctggacgggatatcgatcccgggccagaggctttttcggaagcacagttatacattttcacagtagctcaaaagagcgttaagaaagctgcggatctttacattcccgtgcttgtccgatttcctgcgaatataatccatctcccgtcttacctgttcaaagttgtataaggtatttgaaaattctgtaaacacgtcgttggaatagtcttccagtcccaggtgcgccagattgacaagtccggtggatgccgctctccggattctttgctctacggatttaggattctcgctgaactgggataaaagacggccgagcgtttgctgctccagcgtctccgaccggtcatgcagccaagtaattaaagtgatgatgtccttgcttccaagctccccgatgatccccagtttttgtagtacgtttgtaagccggctctgaaaattttcggactggggggagggattatctgattgcctgccgttttcggaaaactccgtctcaaaaaggctctgtactttaccaatggtgcggtgcatggacagtgttttaaggacattgcggattacagattccacctcaatcgcatttaacggcttctggatgaagaattcgatccccgactcgtacgctttagcgatcagatccttggaagcaacctgggataacatgatgcaggcggattccggagaaatcttccgtgccttttccacaaagctgattccatccatatccggcatgagaagatccacgatgataatatccggatggagggcagctacatcttccagggcatcatccccgtttccggaggagccgcaacattcgcccagattccgttctgtcaccaggattttcagtatggtccttatatttttatcgtcgtctacaaagtaaaatttcattctgaaccctccaatgtttcttttggcagccggatagtaaaacaggtcctccccggacaggactctgcctggatactcccgccaagcttttcttctacaattccttttacgatattcagtcccagtccccggctgatctccccggtctcgtaattgatctttgtggaatatccggcgtcaaagatctgtgggagagactccggggcaatgccaggtccctgatccacaacagaacagcggatctcatgtgccgtttcctccacattgacggagatagaaacttccgtctcctttgtagcctccaccgcattcataaacagattacggaagacggaaagaagctcgtatacgtgggctgtacgaaacgtacaggaaccattgagtcggaatgtaagcgtcttgttcagagaggccgcaaactgtttaactggtgtctgtaacagggtaaagagctcgtcaaactccagaaagcggctgccgtcctcagtcagaagtgcctctgaaagtccccgcagaatcaagtagtattctttcttgatttcgtgaatatcatttgcgatgatcagtgcatccttcgcggcgtcctttgtaccggaatccaagcggagacgctcgaagagctggtacgcggaatgcatcgtcgactccacgagggacgtatttttctccatccagatgacctcttcctggagtctcgccgtcagaagcgaaagatgccgatagtaatcctgctgctctttttttaggaggacgacatgatacctgcggaataccgttacaaaaatcaggatcagggccgtccggaaaagtgcggcgatgataattcccgattgcgaagatgccgaaaatgcattaatattaagacgaagcatcagttccccaaagttcgccgcatagtcgcagaaaagcagggcgatcgtgtccaacaggatggaggacttccgcatcctgacgaggtagagcgtcaggagcactccgtagaacaggtaaaaaaacagctccggaatggaggaaacaaaggcgtcccccagggaagtcccgttaaaacttccgtaaaaagtacgggagagcaggacaaagatgccggatatggcggacaccgggatcaccggaaagtcctgtgcaagcatggaaaaggacgccagaaaaacaatccccagagaaacactgaactcaggcgaaaagatattaatatgaaactgggctgccgccgcggtaatcagactgtaaaatacggcgtgcagaaaaagatcaaagcggttccgagatttcataggtctgttatcctccgtaaaatcttcggtctcaaacaagtgaaacttagattagggtatttttgtggatgtctgaattattataaaacattttatcataaaaaaggagaaaaaaacatggtgaaacgggaagatttatatggaattgcatattataaaaagtcagcctattatggaagcgcgaaaccggacatccggtttcggattgcactggatatggagaaagggaaactggaggctgctgtctggaaagaaccgtactgctatgatgtgacgccggaagaagagattgagcgaaaagaatttccggcggacgatgagggactctgccagattacagactggattaacgaaaaggcgaaatagagaatccggaagaggaaagcaattcgggcttcccatttggaaaagccgtgttatagtagaaagcgtgtgaaacaaaagaaaaaggaaggttgagagatggctgagaaaacaggggtcattcatggcagattccagtgtctgcatttgaaacatatggagtatctgatggcggcaaaaaatcagtgcaaaagactgattatcgggatttctaatccggatgcaggatttatccgggtgaatcttcacgacaaaaaccgttccaaaccggagaacaatccattcacttattttgaacgctacgagatgattcgacttgccatgctggagtttggcgtgccgagagagcagtttgagattgtcccattcccgatcaatacaccggagctcatttttcagtatgcgccaagggatgcagtgtactacatgagcatttgcgatgattggggggaggataagtaccggacactaaccggacttggcgtgcaggtggaagtgctgtggaaccgtccgactgaggagaagggaacgacagccacggaagtaagacatctgatcatagatggaaagcggtgggatcaccttgttccgaaaagtgtgtaccgttatattacagaacatcatctggatgaaaggatccttcagatcgcaaaggaagccggaaagacaaaatgaggctacagtcatcagagaaaataaagggggagactcctctccaacctctcagactttagaaacgtctgggatgcttgcagggaagtctccctcctgtcatgtttctaaacagcgataccgatcacacggcttagcggatgatggttccggtccggcctttcagtgcgtcacgaagcgcctcctgacaggtaatgtaagccaagcggccttcgcccttttcgatgaaggagacggacgcacggaacttcggcagcatattgtagacgccaaaatgtccctcctccatatactgctttgcctgggagacggagatctcaccaagctgtttttctttgtctgtaccacggttaatgaagactttctccacacttgtcaggataatcagtgcgtcggcattcagctcctctgcaagtttccctgccgtcaggtctttctcaatgacagcgctggcgcctttgagacggtgatcctgctcaaggaccggaattcctccgcctccacaggcgatgacaacctgatccgcatcggaaagggtccggatcgcgtcaagctctacgatcttcaccggattcggtgcggaaacgacacgacgaaacccctttccaggctcctccaccacatagttgcctttttttcgctctgctgcagcgtcttctgcggacatataacgtcccagaacttttgttggggtgtaaaatgcctcgtcgtacggatctaccgttacctgggtcagaatcgtactgacggtacggtaaattccccgtgtaagaagttcctcccggatcgcattttgaagatcaaatccgacgtagccttgtgtcattgccgagcagacagacatcggagctggagtatagtctggatggttcttgccgaattcattcatagcagtgtgaatcataccaagctgtggcgcgttactgtgtgtaatgacaacctgatagccgtcctgtacaagatccgcaatggattttactgtcttgcggaccgcaatctgctgctccgggagcgtcgttccgagggctcggtgtcctaatgctacaaccactttttttttcatacgcattacctctatttctctttgtagtttcgtgtccatgataaaaaaattatataatttttccagggaaaatgcaaccgtcattcggctgcaacacccatgttttctggaaaaataaaatagttagaaaattgtataaaataccatatatagtagaataataaaaaaatcacaagatatggtagaaattatggatcacctctgctataattgggattgtcgccggggacgaagaacagaagtcccgggcaaattcagggaaaacagtgaggtatgatatatgaaagtaataaagagagacggacgggaggctgagtacgacagaaataagatcgtccatgcaatacagaaagcgaataatgaagtcgaaaaggaggacaagatctccgaggagaagatttatgatatcgtagcttccattgagaaccggaagcttgccagtatggctgtggaggatatccaggatatcatcgagcagaagctgatggaggagggcaaatatcatcttgccaagaaatacattatctaccgctatacgagagcgatggtgcggaaatccaacaccacggacgattccattctgcgtctgatccggggcgagaattccgaattaaaaacagagaattctaataagaattccacccttgcttccacacagcgtgactatattgcaggggaagtgtctaaagacctgacaaagagagtgcttctgccagagaagattgtaaaagcgcacgaggaaggtgtcattcattttcacgatatggactatttcctccagccgattttcaactgctgtcttgtaaatatcggagatatgctggataacggcactgtgatgaatggcaagctcatcgagtctccgaagagctttcatgtggcatgtactgtaatgacacagatcattgcgtcagtagccagcagccagtacggagggcagtccgtggatatccgtcatctgggcaaatatctgcacagaagccacgagaaatatatgaagaaatacagggagaaatatacaggagtcctttctgaagagttgatggagcagcttgcggacgacagacttcaggacgagctgagatccggtgtacagacgatccagtatcagatcaataccctgatgacgacaaacggacagtcgccgtttgtaaccctgttcctaaacccggacaaatctcatccgtacgcaaaggaaaacgcgatgattattcaggaaatcctgcgccagcggatcgaaggaatcaagaatgaggcaggagtttatgtaacaccggcgttcccgaagcttgtctatgtcttaaatgaggacaataatttaagtggtggggtatatgacgacctgaccagactggctgtaaagtgttccgcaaaacggatgtatccggactatatttccgccaagaagatgaaagagaactacgaaggcaatgtcttctcaccgatggggtgccgttccttcctctccccttggaaagatgagaatggaaattataagtgggaaggccgtttcaaccaaggcgtggtcagtcttaatcttccgcagatcgggattttggcagaaggagatatggaaagattctggcagattctcgacgagagactgtccatttgctttgaggcactgatgtgccgtcacaaggcgctggagggaacaagctccgatgtgagcccggttcactggcagtacggcgctatcgcccgccttggaaaaggcgagaagattgacaaatatctgcacggtgggtactctaccctgagcctaggttatatcggactttacgaagtgacgaagctgatgacaggagagagtcagacgacggaggaaggacagaagtttgctctcaagctgatgcggagactccgtaccgcaaccgatacatggaaagagacgacaggacttggattcggtctttacggtactccggcagagagcctgtgctaccgctttgcggaaatcgatcagaagaaattcggaagcattacagatgtgacagataaaggatattacaccaattcctaccatgtggatgtgagggagaagattgacgcctttgataaatttacttttgagagtcagtttcagacgatcagcaccggaggatgcatctcctatgtggagatcccgaatctcaacaagaatctggaggcagtagctgaggttgtgaaatttatctacgataatattcagtatgcagagttcaacacgaagtccgattactgtcaggaatgtggctatgacggtgagattatgattaacgatgagttcgagtgggaatgtccggtctgccacaataaggatcaggcgaagatgaatgttacaagaagaacatgcggatatctcggagagaacttctggaatccgggaaagacaaaagagatcaaaagcagagtgatgcatttgtaggtaaaggagctttggaacgatgtattatgcggatatgaaacggtgggatgtggcaaacggcccgggcgtacgggtatcgctctttgtgagcggatgcacacaccactgtaaaggatgctttaataaggaggcgtgggacttctgttatgggaagccatttacagaacagacagaggatgagattctgcgagagctggaaaaaagctattatcacggatttaccctgcttggcggggagccgtttgaatatgaaaatcagaaagctctggctccgtttttgaagcgggtgcgggagaaattcccggatctttcaatctggtgctattccgggtacgtcttcgataaagagatcctcgcgcagatgtttccaaagtggaatgagaccagggaaatgcttgactgcattgatgttctggtggatggaagatttgtagaggagcaaaagcaggtagatctgctctttcgtggttctgccaatcaacggctgatcgatgtaaagaagtcgatggagacaggagacgtcgtgctgtgggaacagccggaatacatccatgtagaagtcaaagagaatccaaatgaggtggggattccaccggagacaagcgggaaataaccggagaataaacagtggaggacttatcttccgatagccttgccgttattttgatcatacagaatttgtaacgaaagcacttacagaaatgtgagtgcttttttcatgggagtagacaagaaaatgaaaaggtaaatacgggattacagacagtcgataataaaaaatcgcagagtttgttactctgcgaaaaatttttaaatgtaaactaataaatgaaatcttttcttaagattaccattcatcattatagcacaacaagtaaaaaaagcaatcggattgtacaggatccagcaagaaaatcttgtcaaattcattgtccacatatctatcattataaaaaattttctatattctaatatttccacaatttatgattttaaaacagaccatgtttttcctggttttcgcagagtaacaaactatacgaaaaggagggagcggccatctggtacatgcaaaagtgcgtcaaaggtcaggaagaatctgctgtccgggactggaaagcacagcacccatctggacgggaggaagccttcttctttacttatgaccggctgaaacgttttgaaggggactggcatttgttgaaactgccgctatttccggggctcatttttctggaatgtgaacaagagattccccaaaagaagtcccggctcatgcaggaccaggattccggggcgatgcaagtggattacaggactgaggagttcctcagagaactgggaggggaagcccatcatgtttccatgtcaagaggagtcatccgaaatggtgtgacgattgtgaccgagggacctctggaaggaaaagaagcaaagatccagaagatcgaccgacataagcggcttgccaaaattggcggaggattgaacgtccctttctgccaggaagggggattctgggcaggccttgaaatcacttccaaaagtgaaggggtgtgagcgtatggagaattggtatgcgatgaaaacaatgcccgaaaaagaagaggaagcggcagaactgatccggcggaccatccccccttctttgtgggaatcctgtacaatccttcagaagaaaaagctgttccgggcagacgggaaattgattgtgagtatggagaagatgtttccaggctacctctttttacaaacagaccggatccaggatgtgtcagaaatgttaaaacgatccagagaatatcctcatcttcttggggaaggcgggggacaggcagtccggatggaagagaaagatctggcatttctgaaacaggtctgcggggagcagctggatcagccgatgggactttcccaggtagaggcagacgaagaagggaatctgatccgggtggagggaatcctgcgtccttactcccaaaagattgtaaggaaacgactgaggaagcggtatgtgctggcagaggtgggactctttggaagacaggaaaccgttttatttgggatctgtctgccaggagatcggatctgggaagggagaagataaatacggcagaaacactttcgacgacagtaaagactgccgggggaagactgcggtaagaatgggaagagagtccagggcagaggccgtggaatggcgaagcatactcttttgtaggaggaagaatgtggtatgtgattcagattatgacaggcaaagaagaaatgatgcgggaaatgattacccggaatttgccaagtaagatgtatgaagactgcttttatataagaagagaacggatctggcgcctgaatggagagaaagtatgtcatgtagaaacgatgtttccgggctatctgtttgtgacgacagaagacccggaagcaatatattggaaactcagagaaatcccgggacttacgaaacttctgcggacagaggagagccagtttttgtcagtatcgccggaggaacaatactttttggaagatttaattgacaaagatgaggagaagattgtgcggttatcagaagtgacgctggatgaggagaagaagatactgtcggcaaaaggaccgctcagaaagtatgtaaaacagatcgtgaaaaagaaaatacgattatgttatgtaatgatagaaaaagaactgtttggacagaaaaggaagatattgatcggaatccggacaggagaaaagaaatagatgtaagaagctctaaaaggggcttctttttttataaagaaggaatgaaaagagggagaacgatggataagaaaataaaaccttttgaaacaaaagtatggctttccagcccgacgatgcacggaccggaactggagtatgtcaaggaggcatatgaaacaaactggatgtcgaccgttggggaaaatattcatgaaacagaacggcttgcctgcgaaaagatcggatgcaaatacgcagtcgcactttcggccgggacagcggcgctccatatggcggtcaaactggcaggagtaaaaccgggagagcaggtattctgttcggacatgacctttgatgccaccgtcaatccggtgggttatgaaggaggcgtgccggtctttattgacacggaatacgaaacctggaatatggatcctgcagcattggaaaaagcatttgagctgtatccggaagtaaaagttgtcgtagtggcgcatctttacggtacgcctgggaagatggatgagatccgtggaatctgtgaaaagcatggcgcggttattatcgaagatgcggcagaatctcttggtgccacttataaaggcgtgcagacaggaacatttggaacttataactgtatctcgtttaatggaaacaagatcatcaccggatcttccggagggatgcttctgaccaatgaggaagaagcggccaataaagtgcggaagtggtccacacagtccagagagaacgcaccgtggtatcagcatgaggaactgggctataactaccgcatgagcaacgtgatcgctggcgtcgtacgggggcagtttccgtatctggaagaacatatcgcacagaaaaaagcaatctatgaaagatataagaaaggattgcaaggccttccggtgaaaatgaatccttatgataaagaaaatagtgagccaaacttctggctgagctgtctgctgatcgatccggaagcaatgtgcagacaggtacggggagaacaggaagctctttatatcagtgaaccgggaaagagttgtccgacggaaatcctggaaacattggcaaaatataacgcggaaggccggccaatctggaagccgatgcatatgcagccgatctaccggctgaatgggtttgtcacaagagaaggaaatgggcgtgcaaaaaccaatgcctatattatgggaggagccatgggagaggatgggagaccactggatgtgggaatggatatcttccaaagggggctgtgcctgccaagtgataataaaatgacagcgaaagaacaggagattgtgattgagattattagagggtgttttgagtaggtgtgagatatgaagagaaggaaaggattttatgaggtatgcgtcaaaaggccgttggattttatatgtgcattgggcggaattattgtgttgagtccggtgctgctggtgacagcaggattggtgaaaataaaactgggaagtccggtgatttttaaacaggaaaggccgggaaagaatggaaggccgtttagactttacaagttccgaacgatgacagatcacaaagatgaaaatggaaatcttcttccagatgatatcagattaacaaaatttggaaagtggttaagaagtaccagtttagatgagctcccagaactatttaatattttaaagggagatatgagtattgtaggatgcagaccgctgttgatggaatacctcccatactatactccagaggaatttcaccggcatgatgtgcggccgggtcttaccggacttgcccaggtaaatggcagaaacgcaattagttgggaaaaaagatttgcatatgacttatattatgtagaacattgcacactaaaaatggatattcagatactgaagaaaacagtagaaaaggtattaaaaaaatcggatattcttgttggaagtgagatcccggcaggaagactggatgatgcaaggagaagatcagaataatgcggattagtatcagaaagatggagaaaaaggatattcctttgaaagtgaaatggatcaatgatgcaagaaatcatcagtttttacactatgagcttccccttgatcaacagaaaacagaaatatggttcaataaaacaaaagatcgcacagatagatttgacggaattattgaagtagatggttgtcctgttggagtaatcggaattcttggaattcaggaaaaacaaggggaatactatatcacaatgggagagcaggcctataaaggaaaaggggttgcggcagaagcaacacggcagattcttcgatatgcgtttacaaaactggacttggataaggtttacttatatacagaatgtgagaatatctctgcacagaaactttttgaaaaaacaggatttcagaaattaggaacagaatgtggaaaagtaaaaaacagaggaagaaatgtagatcgtttttattatgaaatatcaaaggaggagtttaaaaaaaatgggaatcccgagttgtaaaacacctgtttaccttcttgaaaagaatgaaaatcgactttatataaaacgagaggatcttctgccgttttcttttggtggaaataaagcaagaaaggcagctctgtttttacaggatatcaaaaagaaaaatgcagattatattgtcacttatgggagtggaagttctaatcacggccgaattattgcaaacatggctgtgtcagagggatttccatgtatgattatcagtccccaagaagcttctgacaatacatataataggaaaatgatggagtattttggggcaaagatcatagagtgcccggttacagaagtccacgatacgattgagcagaagctagcggaactttgccaggaaggttggaacccttattttatcatgggtggaggacatggaaatatcgggacagaagcatatgtacaatgctatgaagagattagggaatatgaggaacagcgacaacttcactttgattatatttttcatgcatctggtaccggaacaacacaggcaggattgatttgtgggcaactgttacatcaggatgacaggaaaattgtaggaatcagtattgcaagaaaaaatccttatggaaaaaaggtcgtttgcgacagtgtgaaagaatacctgtcggatgtttcgacggatgagctggaggaaaagatcatttttcttgaccagtataccggttcaggttatggtaaagaaaatcagaagatcgaaaaaacaatcgaggaaagcctcagaaaatatggaatccctatggatacgacttatacggggaaagcgttctggggaatgaaagaatatctgaaagagaagaaagtaactgacagtaatgtgttatttttacatacaggcggaacgccattattttttgaatatttaaaggggaagcactatgattaatattttagtattgagtgtagggacaagaaataaaattatacagtatttcaaaaaagaattgcagggaaaaggaaaagtagtagcaactgatatgagcagattggcaccggcgttatatgaagccgatgccttttatattgttccaagaatgacagatcctggatatattgaaaaaattttggagatctgtaaaaaagaagaaattaccggagtattgtccctgattgatccggaactgtccttaatagcacaaaataaagggcggtttatggagctaggaacttgcgtaattggttcggactatgaagtctgtgaacggtctctaaacaaatgggagatgtatcagtggctggagcatcatcattatcgttgtgcgaaaagctatatagacaaaaaagaattttttgtggatgtggagaaaggtgaggcaaaatatccggtttttgtaaaaccggtttgtggaagtgcatctattgcaatcagtaaagtatatgaccgtgaaacgataaatcttttatttgatcataatgatgggttgatgattcaggaatatttggaaggccaggaaattggggcagactgttatattgatctgattagtgggaagctggtatctgtttttacaaaaaagaaactcgttatgagagcaggagaaacagataaagcagtttcttttattgatccggttttaaatgagttaattcaagagtttgttacggagatgggttaccggggacagattgatattgatgtgtttgaaaatgggggaaaatattacatttcagaagtaaacccgagatttggcgggggatatcctcacgcctatgaatgtggggtcaatcatatgagattgattgtgaataatctggaaaaaaaggtgaatcaaaacagagagccagactatgaagaaggaatctttatgatgaaatacaatgaaatatccatattaaacgggggaaaagaaaatgcgaagtaatttcagaaaaaaatgggatgatttaaatttcataatggaatcacaataccgtaaatattcctatcgaaaaaaagcgcgtattcggctgaaaagaatgaacaatggttatcaatgtgatgaagaatatgaaaagatcgtagttccttattggaaaaaatatggcttaaagcctaaaaaaatgtggtatcagatttttgctgatagagataaaaaagtagatccaagatatattcccgatgatttgtggtatggaacgattgtcccatatttcagcaatacacagtttcgccgttttggggaagataaatgtctgcataatgtatggtttccgaatttaaaaaagcctgaaacgattgtaaaaaatatagcaggagttttttataaaggggatcaggaaattatttccaaagaggatgctgtgaaaaactgtctggaatatcagcaggagtttttaataaagccgtcaatagacagtggggaaggcagattaattacttttttcacaccgggaaaatataaaaaagaagaactcgttaaggcactaaaaaaaatgggagccaattatattgtgcagggagtcgtaaaacaacatgagatcctttcaaaactaaatccctcttcattgaatacgattcgaattgtgtcttttttgtttgaaggagaggtatatatactctcttcgattttaagaatgggggccagcaatgcaagggttgataatattggggccggaggatatgcatgcccaatacatgaagatggatctcttaatgaattaggagtaaacagaaaagcagaatggcgatccaagaatcaaaatggaatttattttaaagatattattgttccatcatatgaggatattgtacagactgtgaaaagagagcacagaaaacttgctcactttaagctgatcggatgggatttttcagtggatacaaatagtgatcctatttttattgaatataatgtttgcccgggatcaaatcagattacatgtggaccaacatttggtgatttgacagaaaaagtattggaagaagtattcatcaagaaaacattgaaagatgcacaaaattaatgagataaaggagaaggtgttatgaaaatagcggtagtaggagcaggaaatggcggatgtgcggtagcggcagatatggcatacagaggtctacatgtaacattagtaaaaacatcaaacgcaatgcatgatgataattttgagtttttaaaaaaacataacggaaaaatgaccctccttgattttggagaaaatggaagtatgaatccacaagatttagaggtagtgaaaaaagaaggtcatattgctaatgttacaagggatttggcggtattatccgaaatggatgttattcttatttatattcagacgaattaccacgaagaattgattaaaaaaatcgcgccatatattcaagatggacagatcctgcttatcaatccaggatatttttcaacagcatatgttttaaaatactgtggaaataaaaaaatttctgttgtagaagcacagagctcattcattgatggacgtattatggagccaggtttctttaaggttggatttcggaatgtaaggaatccactgggtgtttatcctgctaaaaatcttccgattgtaaaggaaaaacttgagcagttaggatttccgttctattacatggacagtgtagtgggagcagctttacataatcctaatatgattgttcatacgattgggtctgtgttaagcataccgatgattgatgctatgggaaatgatttttgtatgtatcatcgcgcctttacagaacatgcatggaatgtattggaaaaactggataatgaaaagatggatatattagagacaatgggatttgaacgactttcttatgtggaagcctgcaaattcagaaattctttggatgatgagaaagatgcaaaagaggtatttttctcctatgcggcaatgccaaccagagcaaaaggacctgtgactgttaactcccgttatatcacggaagatgttccacagggacttgttatgctggaatcattgggaaaagcacttgctatttcaactccaatcgcaacatctttgatagaaattgcgggagcggcattgggacaggattttcgggcacatggcaggacaccagaaaggttgggagaagaaaacattaaaaagattttagaggattgtagatagtataatgtaggagaagaaaaataggtatgaaagagacactacggcaaaaatttgaacggttatttcaagatatctatataaatattgatccccatgcatctacatggaaaaaactaaaaataacagcagattttttatgggaaaaatatcgatatgatattgaattgatcgattatatccaatatcgcttttattataaaaaaagggaagaaagagattcatttattactcatgggaaattagtaaaaattattaaaatttgtaatgatcctaattcgcggaagttcttcgaccaaaagccgctttttaatgaacatttccaggagtatataggaagaaaatggcttgatgtaacaaaatgttctaagaatacggttaagaaatttttgaatgaacaaggtaaaatttttacaaaatgtccggatgggatgtttggaaaaggaatacaagttattgaatcaaaatctgttcagaattttgattccttttatgagaaagctctaaaacagaaattattgctggaagaagtactgacacagcataaagagttggctgagtttaatgagagttctgtcaattcttttcggatagtaacgcttgtttgtgcaaatggttctgtaaaggttatggcgggagttttgagacttggtagaaaagggaaatttgcagataatttccatcaccatggtattgcatctttagtcgacgttcaaacaggaatcgtatgtacggttggcgtggataggaactggaatcgctttgttgtccatcctgattctggaaaaccgattgtgggttttaaagttccacaatgggataatattgttgacacagtaaaaaaggccgctatagttcatccggaagtgagatacgttgggtgggatgtgactattaaagaggatggaacgattgtattaattgaaggaaatccaggtgccgatccagatgtgacacagatagaagatcagataggaaagtggcctttatataaacccttactagggcaaatcaagaatcaacaaaaataaagattactaggaggagaaggctgtgaaaataacttttattggagatattgcatgtgatagacaattgttaaaagctagccagaaaaaaggtggatatgattttagccaggtgttttcaaaagtgaaggatatttttatacaatcagattttgttgtgggaaattttgaaacggtatgtggaggtagcaataataattatcaagagcagtatatgacatgtaacgcaccggatgaattggtccaagctatgaaagatgcaggaatttcaatggtaacaacagcgaataaccattgtttggataaagggatcaaaggattacggagaacaataaaatgtttaaataaaaatgaaatagaatatgtaggaacgaatctagactcagaacatgtaataagaatcaaaatgaaaacaatatctgatgttagaattgcgtttttagcatatacgtattctactaatgaatcaaatacaggaattgtattgaacgaaaataatgattattttgtcaatttactaaggaaacagggaagagtagacaatccagaattaaaaggacaatttaacataaaaaaatatttcacaggcaaactttccagtaaacaaaaaagaacactaactagaataattgcaaggactaaattaaaattgggaattccctatatgaaaccgcgtacggataagattgagtatggtgatacgaataataactatataaaactagtgaaaaatgatattgtagaagcaaagaaaatagcagatatagttgtggcatgtccacactttggaggacaatttaatactgtaccaggagaatatgctgaatttttaatgaattatttaaagttagcgggctgtgatatcgtaattggaaatcatcctcatgtagtacagaaaataaaaatggatgataagaagatgtttgcatattcattaggaagttttaatcagtccataagtgcggactatatggtggcagaaagtaaacctgaatattcgataatgattcattgttatattaatgggaaatcaaaaaagatccagaaaatatctttttctattttaaaaattgtagaagataaagaaggaatgataacagtatggccggttgataaattgtaccgagaattatcaacggaagaaaagaaattacttatatcagatataaatgaaatttatcaaagatgcacatcgaatccgctggaaaagatagattcagaatttagtttatattgcgaggatgagaatggaaaagaaattatataaaattagttttacaggagatattatgtgcgagaaaccgttattaaaggctgcgcataagaatggagactataatttttcatatgtctttgaaaatattttatcacttttgcatgaatcaaaggtagtagttggaaatttagaaactgtatttgcaggcaaaaagtgcggttacactaaagaattgtattcttttaatacaccagacaattttgctatagagatgaaaaaagcgggtattcattatgtatcgacagcgaataatcattgccttgatagaggagtttatggaattaatcgaacactaaatttattagatgatttaggaattaagcattttggaacagcaagatctcaagaagagagagataaaattgtgacaatagacataggtgaaaaaaaggtagcacttttatcatatacatatggaaccaatatagaggataatcatgtttaccttccaaaagataaagcatatgctgttaatatgttaaaatctcagaaaaatgaggaaagcaaattctatcaaacgataaacaaaaataattttagaagtcgattatcaaaaagaataagaaagtttacttctttagaacaacggatgaaaataaaacgacgtttggggatattacacaataatcctaaaatcgacaatataacaaaaggagatattgttgaagagaatatagcaaaaatgaagcaagatgttgaacgtgcaaaagacttggccgatttagtaatagtgtgccttcatagtggtggcttgtttaaccaagaaataggtacatatacggaatacattatgcaggaattggaaaatgctggggtggacatggtaattgggaaccatcctcatgttgttcaaaaattccatgtttttgaaagcggtatgaaagctgtgtattcattaggaaattttagtatttctccaagttccatttatatcattcatgaaaatcatccagaaatatcggttttgatgcatgtttatataaacatagatacatgtgagatagaaaaaattactggatcattactaaagattatggaaaataagaatggtatgctaactgttgttgaggcaatgagcttgtataataagttaagtagtaatatagctaaaaaagagctgcgtgataattgcgaaaaggtatatagccaattagtaggaaatcgtgagatttttacaatgaaaaaggaatacactctttgggaaaagtcaaaaaggctggaaacggagggatagatatatgaaaatttgttttttttccataagcagttcaacaaatcaagatggagcttcactttcaatgctaaatattgcctgtgaactggctgagcgcggaaacaagattgttttagttttgagtagtggagcaaacttagagagtttaagatcaaaaaaaaatattaaatgctttatcataccagcatttaatatgagggtgaaccttaattacataacgagaacaactggagtaaaatttactttaaaatatatatgtaataccttttatatgctaaaaatttatagaatattgaagggtgaaaatatcaatataattcatataaatggattaaatcatcagatgggagcccaaattgcacagaaattgcaaatcccatatgtgtggcatatacgccaattaatggaagaagacttgggacaaactatttttgcaaagaacaaggtatgggaatatgtaaaaagagcaaatgcaatcattgctatttctaatacagtaaaagacaaatttgaaaaagaattcaagagaagaattattactgtttacaatggagttccaatcgataaatattggatagaaaagaatgaaattctttataatcagataacgactttcattttaccaggtcgtattgcaccaggaaaaggacagctagatgcagtaaaagctattaaaaagttaaatgaaaagaagaaatttcaagttgaactgtttattataggtaacacggaagatagggaatatgaaaagaaattaaggctttatatttgtgaaaacaatttggataagattgttcatatagagccatatgtttctgacctcaggaagtttcgaaaaaagtgtgatattggattaacttgttcaaaaaatgaagcatttggtagggtaacgatagaaaatcaactggcaggattattggtaattggcgctgatacaggaggaactgctgaaattatcaaaaataacgaaaccggacttttatataaagaaggtagctttatggatttagcagataaaatagaatatgcattaatgcataaatctgaaatgagaactattgcacaatttggaaaagaaaaagctgtagaagagttttcaatacaaagagtcgttgatcaagtatataaaatttatgaagaaataggagaagttagatggcatatgtaagtatattgttttctttaggactagcttttttcttttttaaagcaacaaataatatatataatgctgggacagtttttcttggatattggtcagtactaatttttttaaataagcttgcattagataatttatataaagtaagtgaaatgacctatacatacatttttttaggattagtaggatttgcaatcggtgcattaggggcaattgcaaaaaaaagaaatgattttggaaataaggcaggagagcctaattatttgctttttaagattgcttgcataattgttattatatattgtctttatagaattacaataattatcacatttataacacagggctattcttggggagatatcaggatgatgaatggaatagctggtgattctggaagcgggactttaaagggaggaacatacagccaaataatacatgattggtttgtcgctccgataatatatttactggcaccaactttgattgtggatatatttttaggtaaaagagacaagaaaatgtttatattatcaatctgtgcaattattctatattcaatatctacagtctcaagagctatatggagttttttaattttatactctttatgtattcttataatctgtcgtggaaaatatcagatacctaagaaaataaaaaaatggataaagaaaattcctatatttgtagtgcttttgtttgtaataattatatttattacacagcagcgtagtgaagattcagaagtaaaaatttttttaaacatgtatgcatatcttgcaggaggcattacactaatggatatacatttacatagctttctggcaaatatacatacatttggcttattttctacatatggatttattcaaccaattttctttttcttaaaaatatttaaaattatggattatccacaagcattattaaatgtgtcgacaattaaagataatttggaggtcttcattccaataagcgacaatattacaatgaacgcatatagtacattattttttaatttttatagcgattttggagtggaaggtataatattaggaagccttatatttggatatatcagtatgagaatttatagaaattttaaattatatagggacttcaaaagtttagttatttatttagttcttattcaatttatgattttttcgatggccagaatatatacatcgttgaccacacgtgcattaatttttgtttgggttattttcttttttaaacgatcaaaaacaggaggaattacattgagcagggagaaagggagtgtatagttatgaattccctaaaaaaaaattttttttatagtacactgtatcagttattatctattatattacctctgataacggcaccctatatttccagagttttaggtccagagaatgttgggatttattcctatacatattctatagcgaattattttgtccttattgctatgcttggttttaagaattatgggatacgttgtgtcgctaaagtaagagataataaggagaaattaagcagagaattttggagcatatggggacttcaggtaattacttcaagtataatgtttgtgatttatctggtttatttaattgtatttcatccaaagtattggaatatagcggtattgcaggggatttatgttttctcggcaatgagtgatattagttggttcttctttggactagaaaagtttaagatcactacgattagaaatactataatcagacttattggagttattgtaatttttatttttgtacgaaatagcgacgatctttctatttatgtatttatattatctatcaatattttattaacacaattagtactatggccttttttaagagaagaaatagttttatacaaaccatcgatcaaagaggtgtttaaacatctcaagccatgtgctattttatttttgcccgtaatagcagtgagcttatatcacattatggataagattatgttaggtagcatgagtactatgcgagaatcgggattttatgaaaatacagaaaaaattgttaatattccatttggagttattactgccatgggaagtgtaatgcttcctagaatgaccaatgttattgcaaataaacaatatggaagaagcgggaagtatatagaagtatcaatgaatttcgttatgtttctaagcagtgctatggcctttggaatagccggaattgcaactgtattttcacctgtcttttttggaaaggaatttacagattgtgggattttgattagagcaattactcctattattgtatttaaagcttgggcaaatgtaatacgaacacagtatttactaccaaatgaaaaagacaaagattttattatgtcattatttgcaggagctatcgtaaatttaataattaattcattattaattcctaaattaggagcaatgggggcagttcttggaacagttgcagcggagggaacagtttgtatttatcaaacggttgtagtaagaaaagaattaaattttagaaaatactttagagattctgtaacctatttgctgattggtggaattatgtatgttttagtagatcagattggagcaaaaatgaaggaatctattttgacactagtgactcaaataggtgtaggagcttgtgtatttatatgtttatgcgtgatttatataatcatagacaagcaaaattgtatccataaattatatataggcagatttcaaaggagagaaaaaagatgacgttaaaaagggaagttgtaactttattaaaaaaattatttcctatttcgtatgtgaaatatagatacaaaacattgttcgggaaaaaattaaatttaaaagatccacataattttaatgaaaaaatcctatggctgatgctttattggcagcatccattgattgttacatgtgcagataaatatcgaatgagaggttatgttaaaaagtgtggttgtatagagtatatgcccaagctgtatggagtgtacaaaagtacagaagaaatcgaatgggataaattcccaaataaattcgcaattaaatgcaatcacggatgcaaaatgaatattatatgtgatgataagaacaaatttgatattgctgagagtacaaaaaaattaaactattggatgaaagataattatgcatatcatgtatatgagccacattatgcacatattaaaccgttaattctatgtgaagaatatattgaaacagatgcaggagtttttccagatgattataaaatatactgttttaatggagaggctaaagtaattcttgtctgcatggaaagacaggatggtaaactacgattagagtggtatgacttgtcctggaatcctttagatatagggcgtgataaaaatgagcaaaaagcaaaaaagcctttatgtttggatgaaatgataaaatgtgctgaaaaattgtcaaagccatttccttatgttagagtagatttttatgataaagatggaaaagctattttaggagaaatgacgtttactccatattatggaatggcaagatattacaatgaaaaaggaaatgaatggttaggttctcttttaagattacctgataaatatcctaaacattataaatagaaaggaaaataaaaaatgaaaattgcagtagcaggcactggatatgtagggttatccaatgctattttattgtcacaaaacaatcaagtttatgcagtagatattatacaggaaaaagtacaaatgattaatcggaaagagtctccgattgttgacaaggaaattgaggagtatttaaaacatagaaatttaaatcttatagcaacaacagatgcagcattggcgtatgccaatgctgattttattatcatttccacaccaaccaattatgatccgaagaaaaactatttcgatacttcttctgttgagaatgtaattgagaaggtattagaagtgaaccctaatgcgattatgattattaagtctactgtcccggtaggatacacagaatcggtcaaagaaaaataccataccaataatattctgttttcaccggaatttctacgtgaaggacgcgctttatacgataatttgtatccgtccagaattattgtaggaacagatttaaaggatgaaaaattaaaaagatcagcagaagtatttgcaaatatgctacaagagggagcaattaagacagaaattcctgttttgtatattaatcctacagaggcagaggcagttaaattatttgctaatacatatttagcaatgagagtttctttcttcaatgaattagacacatatgcggagatgcggggactgaatacaaaacagatcatagaaggcgtgggactggacccgagaataggtacacattataataatccgtcttttggatacggaggatactgtctcccgaaggacacaaaacaattactggcaaattatgatcaagtacccaataatttgatccaggctatcgtggatgcaaaccgcacaagaaaagatttcattgcggaccgaattttagaaaaagcaaatttcgaagaagggaaaaaagtccgggtaggaatttaccggctaacaatgaaagcaaattcagacaatttccggcagagctcaatacaaggtgtaatgaaacgaattaaggcaaaaggagtggaagtaatcgtatatgagccgacattaaaggaggaaacattttttggtagcaaagtatatcatagtctggaggagtttaaatcatactctgatgtaatcgttgcaaaccgttttagtcaggaattagaagatgtcttggaaaaggtatatacaagggatctttttttatgtgattaaagccataaaaatcaagtgaaaataaacaaaaaaggagtgagaaggatcatagttcgtattcacatgattcttctcgctcaacaattcaaagtgttctcacatctttattttgcattgcgtttgtgcaaaactgctactatctgaaaggtattctgttatacaggttctgtgtcattcgacgaaaaattcataatatacatggagtgctcatgtctgactgatgaaaaagtatgttacactatccaaaaagatacggaggtaaagacatgagttatcacaagacggtagagcaatatttggaatattgcaagtttagaaaagaattggattggaatacgttaaaagcatatcgaattgatctgaagcagttcttcgagtatgttcgagaagatattccggaaaaagccgcagtcgaggcatatattacggaattgcataaaaaatataagcctaaaacgatcaagcgtaaaatcgcatcagtcaggacttactatagctatctggaagaaaatgaaatcattcaaagtaatccttttagaaaaattaaagtaaaatttaaagaaataagtttgctaccgagaattattccacgtgaagaaattgaaaaattattgaattatatgtatataaacgaaaatcgaaaaagtgaaaaagcttataaattttggctgagagatgtggccatgatcgaaatattttttgctacaggggcaagggtatatgagatatcgaatatcaaggctgagtgtgtaaatttgaattcgggtcttataaaaattatggggaaaggcggaaaagaaagatatattcaggttgtaacgccggaaattttagagattttgaaaaaatactatatgtataactgcaaagaaattaagaaaagtggattttttttcataaatagtagaggaaccaggtatacagaacagtcaattagactgatgatgaaaaagtacgccagaatggccagtattgaaagaaatatcacaccacatatgtttcgacattcatttgcaacatatttgatagaagagggagtagatgttagctgtgttcaacaaattttgggacatagctctattaaaacgactcagatttacatccacattgctgccaagaaacaagcagaaattttaaaggaacttcaccctagaaaccgaatgaatattttgaagacagcctagaattttaaagttcatattgcattttcaggaggccggcttaatgaaggtggtctttttcgtatgtaattttaaaattaaagcagaatcaaaaaaggtaacaattcgaaagaaattcaaaaacaagaggataacgctatccgtatcggtcagaggttgtagagaaagtaggaaaattggaaggtcagaatacctgaggttagatgtatatatggataaatatattagatatttaaaatgttgtttattatttatggaaatttgtggaaaaaaccaagaaggattgttataataaatatggtaagttatcggtgctagcgataaaaataaggtgataataccttattatcctttatacaatatgttatttttgaatgtaagaatgcagaagaggaaaaaatgtatacaactgatttatttaattttagattcgtagatcgtgatgaggcaagaaataaatttagagctttttttgcaaattcagatggaaacgttttatgggtaaaagggaagagaggattaggtaaaactacttttataaattttatgttagaagaatacacacaatataatttgtgctattttgatattccgaaaaacagtaattctatcgaaataatttctgaattcataaaacagttagaacgccagtgtgatttgaatttcatcgatgaaacgcaaaaatggtataaagaattttattgtaatacatacaagataatacaaaaaataacagccgttttattccctaagataagtaatttaatagaaaccgtactagatactggttattatgtaattacaaaatcagatgaaagaaaagaatcaattgatataatttatcattttatttctttgattctatcccaaaagaaattgtgtatttgtatagataatttatctcgttgtaatatagatacgctacaatttttctttaggattataaaaaattttttgttggaagaaaacttcagggcttgcatcgtaacaacaacagaggatttaagtacagacacaaaagatgagatatttcattttctgccctttactgacatagaaattttacgtttaaaaaaatatgagtatttttttcaaatattagaacctatatttcacctcgacaattttaaagaagaggattttgaatatatttttataaaatgtgaaggaagtcctaaaaaactttcaaccgtaattagtaaattattagaaaaacaagggatttctttccgcaaaaaccaaaaagctttcatagataaatcagtattatccaataagaatttatgtaacctgaatgggggacggctactcggtcgtcttattctgaaaatgagaaagccctgtatgttgtgaatttagaaaacaaattatttcaggtactttgcggagttttagcccattaagcaaatctttttagaaatagatatgtgaataaatgataaacgggatcccccaaatgctgccagttggaattcaagattttggttgatctgtgtagagaacttattttcaagcaggaaaatgtttggttacgatatctcattctgaatgatgcgaatgataacaagatcgaaatgattgtggaagtaaagtatgcaaatgagcgacagatggataagagcgtaaagctttcgttgaaaaagaacaacagatgttctttctccaaagaacaaagagcggcctttggtgagaaatcagatatgaaaaaatctccatatcgacaggatgtaccaggtcgatatggagatttttaattcggattttacctatttaaaaaactgtggcaaatattctttatgtgcctccagaagctcgtccactacgatatttgcaagctcatcgcttgggcagagtggatttaagttcagggcggcaacagcaagatttctgtctccgcttacggccgcttcgattgtcatacgctcgaatgctttgatcatgtgtacatagccgctgatcggaagttttaattctccggtagcgagcggcttcgggccgtcggctgtgatccggcatgccacctcgacagcagaatctgccggaaggtcgagaatcgtaccattgtttctgacattgacatactggatatctccggtgtcattgtagatggactggatcaggttgcatgcggcgtcggaatattttgcgccaccgcgcatttcaagctgctttggcttttctgccagttcttcgtggctgtagagctcgaaaagctctttttctgtttcgcttacgacttcaccgcgaacggtcccggtcttaaactgctccagctcttcttctaactgttcttttgtgaagaagtagtagttgtggtaagggcaagggattgcgcccagtccttcgataaatgccggcgagtatggaagggagacaaagttcttcatctggatcgtatcctcggcgctcaagtgtgcgtatttatcgagaagctcctggaaacgagactcgccgtttacaaatacatcggtagcaaagatgaagtggttgacgccctgaatctccatggtgacgtccttttcttccacacccagcattttcgcaaatccggcaaccatattcaccgggacattgcaaagaccgatggttttcttgaaattagtgtgacggagaatagcttctgtcaccatgcctgccgggttggtgaagttgatcagccatgcgtttgggcagagttcctggatatcctttacaatgtcaaggatgaccggaatcgtacggaatgctttgaacataccgcctgcgccgtttgtctcctgtccaatcatgccgtggcttaatggaatccgttcatcgagaatccgggccggcagacggccgatccgcatctgggtggtgacaaagtcggcgtcttttaatgcttcgcgtctgtcataacttaatacaattttcattggaacgccggccttttcaaccatacgttttgcaagagcgccgacggtttccagtttatcccgtccggcttcgatatccacgagccagagctcgcgtaccggcaatgtatcgtaacgtttgatgaatccttcaattaactccggagtgtagcttgatcctcctccgatcgtgacgattttaacggaatctttcttcatgggaaataaacacctccaaaaatataaaatcatagaaagtggttagaccatactggcgaccattccaatacggtatataccatgataacactttgcccggaaattttccatggaaaacgaaaaaatctttttcagttgtgaaaaacgcacaaaaatggctaaaaacaagggctttttaaacggaaaaacaaggagtattctgtgcagaatgactattttcatgaaaaaaggaaaaaggaattgtaataaatttgtatgatgtggtatgattaacgacagagtggtatagaccatagcagaccataaaatgcaaagaaggaggaagagaattatggtaaaaattttactcgtatgttcagcaggaatgtcaacaagtttcatggtgaacaaaatgaaggattccgcaaaagcacgtggaattgaagccgagatctgggctgttgcagatgcggaggctgccgctaatattgagaaggccgatattatgatgcttgggcctcaggttcgtttcctggagaataaaatgaaagggatcgccggggataagccggttactgtcattgatatggtagcgtatggctccatgaatggcgaaaaggttctggatcaggctcttgaaatcctggggaaataggacaagatttgaaaggataagggtaaggtaagtatgaatgctttcatgcaatggatggaaacacattttatgccgatggctgccaagatcggaagccagcggcatctgattgcgatacgtgacggctttattgctatcatgccggttaccatggtcggaagtattgcagtcttgttaaacgtatttttacgtgacctgccaaatgagtggctgggagagggaaatggttttgttgcggcgatggatccgattattgctatcaatggaaacgtatacttcggttccattacagtccttggtatcgcttttacgatatcgttgggataccatttgtcgaagtcgtacgacgtcaatccgattgcgggtgctgttattgcgttctccgctgtcgtaacctgtatgaatcaaaatgccgtatttaattacatattaaacggtgtggacttatcctcactggattctctgaaagcggcaggactggacgtcattgaaagtgaaggtgcggttgcacttcagaatgtcagcggatggggctatatgggcgaagcctatacgggttccagcggtctgtttacctgcttgattgtagggttgctgtcgacgatgatctatgtgaaactgatgcagaagaaagtgacgatcaagcttccggattctgtaccgcctgcggtcagcaatgcgtttgcggcgattatcccgggtatcgttgcgatttatgtgtttggtattctgacacagatcagcgtacagtttacaggattgtatccgaacgacttgatcgtagaatggattcagaagccgctgcttggtctttcacaggggctcggaagcgtcgttctgatgatgttcctgattcagttgttctggttcttcggactgcacggggataatattctggctccggtaacggaaggaatctataccccggctcttcttgagaacttaagaatctggaacgaaacacagtctacagcggatatgccatatatctggacacgtgggtcaatcaatgcgtatgcgatggctggtggttccggtatgaccctggcacttttgattgcgatctttattgtttccaagaaaaaagattccagagagattgcgaaacttgcgcttccgatgggagtcttcaatatcaatgagccggtgatctttggtattccgatcgtgctcaatccggtatacctgattccatggctgattacagctccggtatgttctgtgatcggatatgtatttacagcagcgcacatcatcccgccggtatacattcaggtgccgtgggtaatgccggtcggtctgtatgctttcttcggaacgggtggcagtgtaatggcaggcgtggtttccctgatctgtcttgcggttgccgtactgatctgggttccgtttgtcatgctggcaaacaggatggaaaataaacaataagtaagagacagaatttcggcaggggaggccgtcccctgccgttctggtaaaaagaaaacgatttcaggaggtaaattcagatggatggtatcgaaatgatttgctttgagattatctcaaatgtaggaatggcaagaggcagttatgtagaggcgatagatctggcgacagaaggaaaatttgatgaagctagagcaaagatcgaagaagggaatcagtttttcgtaaaaggacatgaagcccatgcggatctgattcagaaggaagcagcaggagagaagacggagattatccttgttcttgtccatgcggaagaccagttgatgagtgcggaaaatttcaagattcttgctgagaagtttattgcactgagcgaaaagatttacacaaaataagccggagcgtgcggatatgggtacaggcagaaagaagaacgagaagaaaggttcctgggcggtctttttcatggtgatcggcatgatctttatcatgttgtcccctcaggtggagcagccgatgtcgctgattgtcacggggctggcgatcatcctgatcagtctgatctactggaaaaaagagcggagcagggacgatcagaaatagacagaggttgagacagaatggaaatcagagagaagctaagagtaacggcggaagaattcttttcccagatgatggtgtccgtgctttatgatatcaaaagtgcgacgggaagagatgtgaaacgggaacagattcataaagggtatcattatacaaagaagatgaaaaacaaagtggggagggaaggagacgtgcggatcacagtgacggaatatgatccgccgtaccgatattcagcgtcttttgattctgccagtgggaccaatcggattgagtaccggctggaggaggcgccggagagtggaattgaggtcttttatttggaagactatgagggagataccaaatctcaggatctgaattaccgtattatcggagctctctacaggagaagtgcaaagaaaaggacgaaaaagatgttccatgccatggaggactatattatcaaaaacagagatcaggcataggcagatggaacgggaaggaagacacatggcacgaattggtatttcaatttatccggagcatacgacgccggagcgggaccgggcgtatatggagatggcggcaaagtacgggtgcagcaggatattttcctgtttgttgagcgttacaaaaagccgggaggaaataggtaaggagtttcgggggcagattgattttgctcaccggcttgggatggaggtcatcctggatgtggcgcctgttgtgctgaagagacttggagtgacttatgatgatctgtcgtttttcagtgagatccatgcggacggaatccgtctggatgagggatttgactctctggcagaatccattatgacatataatccccagaatctgaagattgaaatgaatgcaagccttggaaaccgatatctggaaaatattatgagccattgtccgaagactgcaaacctgacgacctgccacaacttctatccgcaacggtacactggacttgggtaccggcattttgaaaaatgcagcagggagattcacaagctggggctcccggtagcggcgtttgtcagttctcaggaaccgaatgctttcggaccgtggccggtgaatgatggattgtgtactctggagatgcaccgggatcttccggtggacacggccgccagacatctgtttgctacaggactcgtggacgatgtgttgatcgccaactgctatgcttcagaggaagagcttagaaatttatcacttctggatccctcattgttgacatttcgcatggaaagagagtatactctctcctgtacagaagaaaagattttatatgaaacacttcattttgtcaggggagacatgagcgactttatggcccgaagtacacagtctcgtgtcctgtatgcggatcaggaggttccggcaaggaataccagggacatgaaacgtggcgatgtggtcattgtcaacgatgagtacaaccggtacaagggagaacttcagatcgtacttatggatatggaaaatgacggccggaaaaatgtgatcgggcaccttccggcaaatgagcggatgcttcttgactacctgggaccatggaggaagtttggcttcataaaatcttaagcgacaggaagggtgagaagattggccgcaccaatatacttgaaaataaaagaacgcctgatggaggatatcagggacaagtcagtcagtacgccgattgattcggaacgcgagctggcagtaaaattcgatgtgagcaggatgacagtccgcagggcggttaatgagctggtagcggagggctatctctaccggaataaaaaccggggaacctttgtctcagatcaggctctgcacaggaagaatacgacggtggacagttttgtaaagcaggagaatgcaaattaccgtctgatttacttcaatgtgcggccggagccggaatatgcggcgttgttttcgattacgcaggaagacttgatgatctgtgcggttcgactgatgatggaagatgatcggccggttacgatcgaggagatttattatccgtattctcatgttcactccatggggatgaaagatctggatgagatgctggatatgaccggatatattgtggacgggacggtgacacagcgtttttatccaattctggtgccgccggaatacagtaatcttctgaatttggagatgaatacgccgattattatggtggaatgtaagattcataatcaggtgggcgagcttgttgcgattgtgaaaatgtaccataatccgaacgaaaaagtcatcgagatgacattataataagaggaaaaatttctgatgccgtaagaggcggaggaatttttcctctttttttgttttgtttggctctttttcttctcttgattcgttatataatatgtaagacgttttacgataaaaatacgaggccacgattatgacagacagagaacgaatacaacgcatcttctccggtgagcccgagcagatgaatgaactgattgaagaatattatcaggacatctttcaatattgttattcccaaacaaggcgggagagtgcggcatatgattgtacccaggagacctttcttcgagtcatccgttatctgaaccgatatgtggaacagaagaaattccgggcctatctttttggaatcgcaagaagtgtatgcattgactttttccggaagaaatcagagagtgaggttggatacgaggaagggtacgaagagacactgagagaagaggattttgcggacagggtgtcggagcaggtgacgatcaaaaaggcgatggaaaagttgaaggaagaacaacgggaagtgctggatctttcgtattaccatggactgaccgcaaaagaaattgcatatgtgacgggagaaagggtcacgactgtgaaaagcaggattcgtcaaagcctgaaaaagctgagacagattttggaagaggagggattcagatggaacggataaaagaaatggaacagctactaaaagaacaaaagaagccggtgccggatccaaagagggtagcggcatgcaaggaacgtatgatggaagaaatcagtcatcaggtgatccttccgtcacgtccgcttttagtgcggatgtgggagagtgcggggtatatttccaggtggacctggggagggcttctctttttttgtgcggtgggcgttctgatggcgcttcataattcctatcagaatactttggcactatgttcaatacttgccccgcttcctggtatctttcttgtaccggaactagccaggagtttttcagagggcatgtgggagatggagcagtcctgctactataatctgagggagcttctgctgctgaagatgattgtgcttggtcttgcctttggcgtccttcttggattgggtgcggtgatgacaagagtggagagcggaagttttgtagattttgaactgtggatttgtctgccgtttttggcagtgagttcactgtccttcttcttattgagaaaaatccgcagccgtcaggcggaatatgggatcatcgggattgatctgatgggagtctgtgttgtcattggtatgtggaatgtcaaagatgaccttcaaagaatgttggagagtgatcagacagcggtgctgctttttgtacttctggcggtgcttttggggagcctcgtgatgaatggaaagaagtttttccagtgtgtacagaatggcgaactggtatgggaagaactgatggaatagaaaggagaacacatggaactgaaactgacgcatgtgacaaaacaatatggaacaaagactgcggtagatcatattaatatgacgttgcgtgaggggatttacggacttttgggagcaaatggagcagggaaaacttcgctgatgagacttgtctgtctcattcaaaaaagaagcggcggagaaattactctggatggccgggaaatccaggaaatgggggaagaataccgaagccttcttggatatctgccgcagaatttcggttactatccggaatttactgcacagaagtttttactgtatatgtctgccttaaaagggctgaacaagcatgcggcgaagcggcggattgaggaacttctggatgtgacggggcttactgatgacagaaacagaaagatcaaaactttttccggagggatgaaacggagactgggaattgcccaggcgatgctgaataatccgaagattcttattttggatgagccgacggccggactggatccaaaggaacgggtgcattttcgcaacctgatcagctccttttctaaggataaaatcgtgctcttgtccacccatattgtgtcggatatcgagtacatagctgatgagattctggtgatgaagcagggaaagctgatccggtgcgggaagccgcagacacttttgaaagatttggaagggaaagtatgggaatgtctggtgccgtttgaggcggttgcggagatggaacgccactttacagttggcaatttgaaaaatgaagagcaaggatgtcttctgcggattgtttcggatatttgtcctgtaaaaggggcaaaggaggcacagccgtctctggaagatatttacctgtatgattttcaaagagaggaggacaaacgatgatttcgcttgttagactggagatacagaaattgtttcggcgtaaatttgtattagttttgcttttgatttacggtgtggtattgctttttatgatttacgcaggaaatccgaaccggttttcttcgattctgacttccgagggagatgtgctaaaaggcagggaagcagttcagtatgaaaaggagctggcagaaagctacggtacgctttccgatcaggatgtccaggaaattctggaggagaacgcaagaatccttggggagtttacggatgagaaccagatgaaagatgacgtgcattatcggtacgccaatggcttttatgctgccgtggcaaaggtgtttaccgatgcggatggaaattacaaccatcttccggcggatcaggtttatcctgggcaagagggattgatgcagggaggctttacaagcggtatggacatgatgcttagctatgtcaccacgtttttactgtttgcggcggttcttctgatcgtgatgatcgccccggttttttcagatgaatacacgtccggtatggactccctgattttgtcatcccgttatgggaagacgcggtgtgcgcgggccaagattctggcctcctttctgactgcggttaccattctgatcggaacggttgcgttcatcgtactggttacgatcggatatttcgggacagatggatttgcagtggatgcccatttgtgtgccacagggatgatcggtatggcgccgtttgcattaccatactggaaagcacttttgattctgatcagcctgggactgggggccattatgatgctgaccggttttgctctggctgcttcggcacttggaacgtcctcctttatcagtgttctggttacattggcattttttgttctgccgatctttttgtggggagtgtgggatattccgtggctcaatcatctcctggaactatgtccggggaatctcgtttcacctgccaaagtatttgcgcttccggcatatcagatcggaggtcacactgttcaggtctatcagatggaaatcgtggctgcagtttgtttcactccggtctgtgctgtctgttcttattttggattcaaaaaccatcaggtgcgctcataaaagggtgcgcctgatgatttttatttcataggaaactgcgttcctatgaaataaaaaacgcgctgcggtggagtggaagctaccgctgaatcgacccgccgcaggcggagaatcctgccaaaaaggattctttttattataaaaactgtatgtcaatcatacagatctcacttttggtacctactctcatatttggtccgaagacgcccactccggaggtgacaatattatgcatggaacctttctttaagtagccgcaggcgttttcccacaccatgtcggtaatcagggtgagaggaaagacctgtccatcatgggtatgtccgcaaagatccagatccactcctgcctcggagagttcatttagctcccgtggctcatggtcgatgacgatgagaggcttcgtcagatccagctcttcggtgagctctttcggtgttttgcgggtgtcaatgccccggcctggtcgttcataatccggtctgccgcacaggtaaaaggcatgatcgatctcgatcgtctcatcccgtaacagggtgatcccggcctgcttaagaaaggtatccatccggggatcgctcatcttttttccatcctggtggaaagtgaatccagcaaggatcggctcttggatatcgtggtttccatagcaggcgtaggtgccgtatgtgctctccaaatcagcgagtgtggaagccagttcttgtggatcgtccagcgcttcgtattcattgtcaaaaatatctcctgcaatgacgacaagatccggattctgtgcgttgattttatccaccatctgccgcatctgtgcggttcccacgctgtaaccaaggtgaagatccgctaccagtgcgatttttaaggagtccagatccccggcctgtttttccacctttacctgataaggcgttatgcggatccaccgggcattcaccatcccgtagatgctgaccgctgtgatgaggatcaggcagagcgccccggcaagagccggacgcagccgggtgaaagtttttttccgaatttttgtatgaacaagccggatgagatcggcggcaacgacaacgagcaccatgtagagcattattcccatccagtagtagccaagaccttttaaaaaccgctgtgcctctcccggaggcgtgagaaagccgatgccgggagaaaaggccacaaacaggtagacaattccgaggacaatccgcaccgcctttttatgaaatacagggtggatggtggaaagccaggtaaaaatccggtgcagcagatatccattgacaagcaggtataccggaagtaaataaactgcaatcataacaaattctccaatcttttgtaacagtgacacattacagacgcacgaacgtcggatgatgtccggtatgttttaaaaagacgtccagaatgtctttggtgcggattttgagcgtagaactgttgatacaagggtggcatccgatatattcatctgtaaggagatcctcatcaatcaaaagagtcacatccagaccggggtcattcatcagccccaaaacacttgcggaccccggtgtaagattcaaatactgttccataaattccggttccgcgaaggaaaggcgggagattcccagttgcccggagagatcctttgtcacgaattttttgtctcccggcattaaaaggagataaaaggtggtcttctgacggttacgaagaaacagattcttgcagatcttgacgccgagttcttgttctacagcttcacagtcttcgatggtatttgcggtatcgtgatccactccttcataggaaattcccaggcggtccagaagctcgtagacatgagcctctttctccagacggtctccacagtctggacgtgcgttaaaatgggttgtatgtacagtgatactcatcgtaaaacctcctgataaaaatgattttcttttacagtataaaaagaaacagaaaaaaagacaagactgtaccaaaagaattaagattataggcttgcggaggcatgggacaccccttataataaagaaagtatgaatttaggagaaaaaaggaaatgagaaaattactgaagtatctgaaggattataagaaggaaagtatgatcggtcctctgtttaaacttctggaagcctgctttgagctggtggttcctttgattatggcgaacatgattgatatcggaatccggaacggggatacgggatatattttaagaatgggcagtatcctcattttatttgcggtgctggggctgtcctgttccctgactgcccagtattttgcggcgaaagcatcggtggggtttggaacggcgctgcggcatgacatgtttcggcacattcagagtctttcctatgcggagattgaccgcgcgggaagttctaccttggtgacgagaatcaccagtgatattaatcaggtgcagtcgggcgttaatctggtgctccggctttttctgcgatctccgtttatcgtggtgggagcaatgctgatggcttttacgatcagtgtaaagctggcgctgatttttgttgtggcagtgccgcttttatcccttgtgatttacgggatcatggtagtgtccattccgctgtaccgccaggtgcagaaacggctggaccggatcctgctttccaccagagaaaatctggaggggatccgggttatccgggcatttggaatgcaggcaagggagcgggaggaatttaaggccaagaacacaaaatttctggcggcgcagatgctggtaggaaagatttctgccctcttaaatcctgccacttatatcattgtcaatgtggcgaccattgcgatcgtctggtttggaggccgggagacctatgccgggggcgtcacccagggagaggtcattgccctggtcaattatatgacccagattcttaccgcattagtggcattgtccaacctgattgtcagctttacgaaagcactggcctgcgccaaccgtgtcaatgaagtctttgatcttgagccatccatccaggatccgtctgtggaagagttagctggccgggagacgtccgtacaggaaatgatgaaagaaaaagaggttacaaaggtcaaggaggccgtggcttttcatcaggtgtcttttgcgtatccaaagagcaaggtctatgcagttacaggactgaatttctctgtgaaacaaggggaaatgattggaattatcggaggaaccggttccggaaaatccacccttgtccagatgataccgaggttttatgatgtgacggaaggtagtgtgactgtagatggacgggatgtccgagactataaaatagaagaattaagacagaaaattggaatggtaccgcagcgggcagtgctgttccgtggaactattcgggataatatgagagttggtaacgaacttgcggacgatgtggagatcatggaggccgtgaaaagagctcaggcgctggaagtggtagaagggaaaccggatggtttagataccatgattaacgagggaggcaagaatttttcgggcggacaaaggcagcggcttacaatcgcccgtgcccttgtaaggaagccacaaattttgatcctggatgacagtgcgtctgctcttgattttgccacagatgcaaggctgcgtaaagcagtcagggatttgaaagatatgaccgtctttgtagtatcccagagggcggcgtccgttatgcaggcggatagaatcatggtcatggatgatggaaagctggtcggaatcggtacacatgaagagctgatggaaacgtgcgaggtctatcgggaaatctgcctctctcagctctcagaaaaggaggtgggacgtcatgtataaaacaaacagtacgtggaagaaagtactctgctatatcagaccctattcgttctatgtgatcctttccctcctgttcgcggttctgacaggggtgctgacgttgtatgctccgatcctggtaggagacgcaattgattatattatcggaagagatcaggtgcttttcgggaaaattgccggtattttaaggaatcttgccattattattgtaattacgggagtgggacagtggctgatgaatctttgcaacaaccagatcacttaccgggtagtgctggatgtgcggctgaaagcctttaagaagctggaaaagctgcccctttcttatatagacagtcacgcaaatggtgatacgatcagccggatcattacggatgtggagcagttctcagatggacttttgatgggattttcccagtttttctccggcgtggtgacgattgtgacgactttgattttcatgctcaccatcgatattaaaattacgctgattgtcgtactgctcacaccgttatctttctttgtggctggatttatagccaagcggacgtatcagatgttccggaaacagtctgagacgagagcggatatgacgtctcttgtcaatgagatggtgggaaatcagaagattgtccaggcgtttggctatggaagtacggcttgcggacggtttgatgagataaacgggaagcttaagacgtacagtctgaaagccattttcttttcttcgattacgaacccaagtaccaggtttgtgaataacctggtctacatgggcgtggggatcggaggcgcgttaagcgctattacaggagccatcagtgtaggacagctctcctgctttctgacctatgcgaaccagtatacgaagccgttcaacgagatttccggcgtcgtgaccgaacttcagaacgcgcttgcctgtgcaaagcgggtatttgattttatcgaggaggagccggagacaaaagacgatcaggacgccgtggttctgacggatgccaaaggaaatctgaaactggaacatgtcggattttcttataaaaaggaagtgccgcttttgaaagggctgaatctggaggtgaagccgggacagaagattgccattgtcgggccgacagggtgcggaaagacgacattgattaatctgctgatgcgtttttatgatgtggatgagggtgtgatccgtatggaaggagaggatatccgccacatcacccgggatagcctgagagaaaattacgggatggtgctccaggaaacatggctgaaatccgccacgattgcggagaatattgcatatggaaatccgcaggccacaagagaggagatcattcatgcggcaaaagaggctcacgcccacagctttatcaccaggatgccggacgggtatgacactgtaatctccgaagaaggcggcaatctttcccagggacaaaagcagcttctttgtatcgcacgagtcatgctgcgtctgccgcctgtcctgatcttggacgaggcgacgtcctctattgataccaggacggagattcaggttcagaaagcgtttgaaaagctgatggaaggaaggaccagctttattgtggcgcatcgcctttcgaccatccgcacggcggatcggatccttgtaatgaaagatggaaatataatcgagcaaggtacgcacgaagagctgctcgcgcagaatggattttacagacaattatatgaaagtcagtttgcatagataatacgggatgggaatcgtcacgtcggagacagaatctcatgtgcggagcattgcaattttgcgttgaaagtgctaacataatatttgtaggaactgacaaacgctttccggaggagactccggcacgacacaaaagaacagatgatgacggggagcttgcgtaggaagcaggctgagagtaagctggaggctttgacccgagacctgatttgggtaatgccaacgtagggaaggaagagaaattgtttatgcgggtataccctgattgggatacccgctttttgtatgagcgataagccacagtccgggtttcctctgacttgtgccgtgatccataccagagcaaaggagtgtgcgacgatgaaagaatgtatggacaatgtgagaaagaatgtacctttagtacacaatatcacgaattatgttacagtcaatgacgtggccaatattctattggcctgtggcggaagcccgatcatgtcagacgagccggaagatgtggaagacatcacgtcagtctgcggcgggctgaatatcaatatcggaactttgcatcagtcaagtatagaggggatgttacttgccgggaagaaagcaaatgaactgggacatccggtgctgctggatccggtcggagcgggggcgagcagacttcgtaccgacacggcgcttcggattatgaaggaaattaaattgacagttattcgtggaaatatctctgagatcaaaacacttgcttatggtagtgggacgacaaagggtgtggacgcagatgtggcggacgcggtgacagaggaaacgctgaatgacgcgattgcttttgtgaaaaattttgccagaaaaacaagttgtatcattgcggttactggcgctattgatctcgtttctgatggggaaatctgttatgtgatccgaaacggcagaccagagatgggtaagattacagggacagggtgtcagctatcaggaatgatgacggcttatgtgacagcaaatcaggagaaaccgcttgaggcagccgcgtcagccgtgtgtatcatggggctggcaggtgagatcggatggagccggatgcaggagggagacgggaacgctacttaccggaaccggattattgatgcagtctatcagatgacaggagaagatctggagagaggagcaaaatatgaagtacgctgataaacttttgctttatgcggtgacagaccgaagctggttgggcggcaaaacgctgtatgaggaggttgaacatgcgattcagggaggagtgacctttgtccagctacgggagaagagactggaggataccgcatttttaaaagaggcgcaggaaatccagaagctttgtaaaaaataccatgtaccgtttgtcattaacgataatgtagagattgccgcccggatccatgcggacggcgttcatataggacaaagcgatatggaggtcaaaaaggcgagggagaggcttggaaatgagcggatcatcggggtttcggctcaaacggtggagcaggcggtccgggcagagagggacggcgccgactatcttggtgtgggggcggtattcccgacaggttccaaggcggatgccgtggaagtggatcaccagacgctacgggagatctgcagggcagttcagattccggttattgccatcggaggcattacaaaagataatgtaaaagagctgaatgacagtggaatttgtgggattgcggtcatcagcgcgatttttgccgagaaagatacgaaagaagcggcaaggagtttaaaagaaaagactatggaagcgctcggtatcatataaagggaatccgctcaatggtgaaaggaggcagtgcatatgataaaaggggtcatctttgatgtggatggggttcttctggactcgatgtccgcatgggaaaatctggggcagatgtatctgaaacacctgggaatttctgcagaagcagatcttggggagattttgtctccgatgagcctggaggaggcagcaaggtatctgattgaccattatggactaaagtggaagccggaagaagtggtgagaggaatcaaccaggagctgaaagaattttacgagcatcaggttttactcaaaccaggcgtggagatttatgtcaacgaattttgcaggagaaacatcccgatggcgatcgctacatccggtgaccgggaaaatgcagaagcggcgttggacagattgggcgttctttcatactttgagggaatctgcacctgctcggaaaccggatgggggaaaagccgtccggatgtctactttgcggcggagcgtcttcttcatacgaatccaaaagaaacatggatttttgaggatgcgctccatgccctacggacagcaaaaagggctggatttcagacagtcgggatgtacgacaggtcaaatgaaaaagatcagggaaagatccggaaggaggcggatctttacctgacaggctgggaacgttttgaatggttttgggaaagagcgtcgacggtcttctaagaggaacggcatgtgtttccagcggcagaccgggggcaccactttctgtcgcgatagaaaagaatgctgaggaagtaaaaaagaaaggatgttgaaagatgagaacagcattgacaatcgccggaagcgattccagcggaggcgccgggattcaggcagatatcaagacaatgaccgcaaatggtgtgtttgccatgagtgcgattaccgcactgactgcacagaatacgaccggcgtgacagggattatggaggtatctcctgaatttttaaaacagcagatagacagtattttcacagatatccggccggacgcggtgaaaatcggcatggtctcttcaggggagctgattatggcaactgctgaaaaactggaacaataccgcgctgaaaagatcgtgattgatccggtgatggtggcgacaagtggagcaaagttgatcagcgacgatgcgattgacacattgaagggcaggctcctgccgatggcggacatgatcactccgaatatcccggaggcggaagtactgtcaggaatgaagatccacacagaggaggatatggtgcaagctgccggaaatatcagcagcagatatcagtgcgcggttctggtaaagggcggacaccagctgaatgacgccaatgatctgctctgcagggatgaacactgccgttggttttatggaaaacggattgacaatcccaacactcacggaacaggctgtaccctgtcaagcgcgattgcggctaatctggcgaaagggtttgatatggaggagtcggtaagacgggcgaaagattatctctccggagccctgggagccatgctcgacctggggaaaggaagcgggccactggaccatgcctttgtcattacaggagagtatcggaaagaatccatggattgtggaagtatggaggcgtgagtatatgaatgggaaacgtagagattccactcggaaatactctgcctgatatggtgatcgtaatcgtattgtgtgtacttgtagatacgataagacgcggaataaagaagtagaacgtattccttcataaaagtaaatgaaagtacttgacaaaaatttccgggggggggtaaaattgttataagattttgcttgacagaagagaaaagaaatgcaattatggtaaagagttaagaaaaatcattacaattttaggcatatggaggaaaaggctatgaatgagagtgttcagatcgagatccgtgatctcaccaaaatttataagctgaacaaaaagcagatgcaggaatctcacaccaagaatccgaagaagactgcggtagatcacctgacgctgacggcaagagcaggagagatctacggacttctgggcccgaacggggcagggaagacgacgacacttcgatgtatcgcgacgattatcaagccgacgtcgggagagatctttgtgaatggcaatgaggtacagaaacattcagaagcagtcagaaagagtatcggatttctgaccagcgatattaagctggacccacagttttccgtggattatctgtttgatttctttggagaacttcgagggatcgcgccggcgcagattaaacgcaggaaggaagagctctttacatattttggaatcagtgatttcgcccacaaaaagatcaaggagctttccaccggtatgaaacagaaggcagcaatcgctgtcagcctggttcacgatccggaagtggtaatctttgacgagccgactaacggacttgatattattactgcaagaggtgtcacagactatttaaggaagctcaaagaagaaggaaagcttgttattgtttccacacatatcatgtccgaggcggagaagctttgcgaccggatcggcattattatcgatgggaagaagagagcagagggaacccttcaggagctgcttgacgagacgcggacacaggatctggaagatgctttcttccaatactttaaaagcgtaaagggggaagcataggatgagaacgatttataagaaagagcttgcaagaatatttaaagataaaaagatggtcttttctgttttcctgcttcctgtcctgatcatggtcgggattatggcgctggtaggcaatcttaccagccgtcagatggaagacatcgaaaaccatgagtccattgtatacatgatgaacgagccggagagctttacggctttcttggatgcttcggacctgcacatggatgtgaaatccgttgagacggaagcagagcgcgacgatgtgatgtctatgctcaaggaaggagacgcggatctctttattgaattcccggaaaatttcgattccctgattcaaggatatcggcagggagacgaggtgccgcagattaagacctattacaatccgtccgaagattattcttccagtgcttatgagctgatctccaatcagtcgctggaagcgtatcgtcaggtactgctctcccagagagtgacggacatgaacgagcttcaggtatttacagtcaacagtgataataaagacatggttgttcaggacgatcagaaagcgagcggcaaggcgcttggaatgatgctgccgtatttcatcaccatcctgctctttgcaggcgcgatggggatcggaaccgatatgatcgcgggagaaaaagagagaggcacgatggcgagccttcttgtgactccggtcaagagaaaatccattgtactcggcaaagtctttgcactgatgacgatttctgggatctcctcggtgatctacatcgtggtgatgggagctacattcccgaagatactgggaggagacagtggtcttgaccttgagattacaccggaacagatcgtaatgattggcgtgctgttggtagcgatagcatttctttattcagccattgtcattctgctctccgtctttgcgagagatttaaaagaggcaagtacctatattaccccagcctacatggtggtactggtgatcggtatgatgaccatgtttacgacaagagaggctggcatgaaagattacctgattccgttttataacacagcgctggcgctcaaaggcatcctcacatcggaagtgacgatggcacagtatggtgtgacccttgctatgaccctcgttcttggaggaatactgaccgcagtcattgcaaaagcatttgaaagtgaaaaggttatgaacctctaaacatggaaactcagaaatccgaatgcaggcgggaaacaaaagacaatatggcgcatatgctggtgataagaccggcatatgcgcttttgcattggctacgatctaacgtcagggtttatcaggaaccctggcggccgatttgctgcggccggggcgataggagggaagacggatgagactttgcgatctgagagaaaaagaagtcatcaacacagggaactgcaggagacttggctgtgtggtagatctcgtagtggatatgaagaaagggtgcgtgcaggcgattgttgtgccggggcctgggagactctgtggtctgttcggatatgacagtgaatatgtgatcccgtttgagtgtatctgtaaggtaggaccggatatcatccttgtggatatctgcgaagaaaaatttctctgtgagtgcaggtaattctgggtacgatctgttgaccgtcattaccggaagatggtatactgataccagattttggagaaaggatggtacttcagatgaaatgtccatactgcggcaatccggacacaagagtgattgactcccgtccagcagaggacggatcttcgatccgcagaaggcggtcgtgcgatacatgtggcaagcgctttacgacctatgaaaaagtagaaacaattcccctgattgtgattaaaaaggataacaatagggagcagtacgaccggggaaagatcgaaaagggcatcctccaggcatgttataagagaccggtgccggccgaggtgatccgaaagacagtggagcagatcgagacagagatcttcaatcgggaagaaaaagagatcccaagcaaagtgatcggtgagatcgtcatgcacaagctcaaagatctggacgaagtggcatatgtgcgctttgcgtctgtctatcgtgaatttaaggatgtcaatacgtttatggaagaattaaagagtatactggataagaaataggtgaagggagatactttgtaaggaagtgtctcccttgatttatatctcataaaactattgacgaaacagaaaaacacccttataataactaatgttatataacaatagatatttaaaggaggaagtaagatgccgcctaaaaagaggatcacaagagaactgattttgaaaaaagcatttgatatggttcacgaggaggggattgacagcttaaatgcgagagctctggcgaagaagctgaactgctctacaatgcctattttccagtccttccaggacatgagagacttgaaaatggaggttaagcgctggattgacgagtactacagtgcgtttcttaaccggtatgtgcaaaaagaggattacctgtttacgatcagctttgcttatattaattttgcaaggatggagcatcattttttcggagcactgtttgtgaatccccttcttgattccaggacagtccgggaagtaattgattcgccctggaacagagagacgattaaatgtaccgctgaacagttcgggatttctatacgggagagtgaggagctttacagggatatccggttttatgcccatggaattgccacgcagctttatggagggaacatgacgctcggcgaggaggagatccagggacttttacatcatgcgttagaaaggtttttacaatgaaaaatttacaaattatccgacgttattttcaggtgacaaaggcagacaggaaaatttcggtttttcttgtgctgtcttctataatggcaaatggaccgtatctgtttgtgagcctgttgttcagtatggcgattgacagcttgtccaagggagatgcgaaccgggtcatgctgatgatggtgatctatttccttttgaagatttgttcgaaggtgttcaagattataagtcttatggtagagcggagactttataatgatgtgtacagaaaacttcaggatcagatggtggagaagctggaccggattgaaatgacgacctttgctgtctgtaataagggagaacttttgaatctggtcaatggggatgtgagagttctggcagaattcggaacctggctttcagaggcccttttgttgttgttctcctttgcagtttctatcgtcgttctggcgaaaattagtctggggctgatggctgtcggatttttggtcaatgccctggtgatctggattttgaatatttataatgaaaaatatgagaagctgaccaaggaagggaaacagaaaggagacgatgaaactcgcttttatggagaacttctttccggaatgagagaaattaaaatctttcagatgctggctcccctgcacacaaagtaccgcagacttaacgaggcatatatcgatgtacataacaagcagattcggaaccgagtcatcagcaatattttaaatccgagcattacgatgtgtatggagatcgttttgatgatctatgcatgctggcagtgtttgcacggagtctttgggatcgatacggtgctcatcatccagtcctattttggtacgatgtttacatctttaagcgaccttgtcaccgcccttggagaactgcggatcaaacatgtttccattgaccggtacgatggttttatgcggaaaaaggaggacgagatgacagagacagaggtagtggtggagagtaaagactatgacatccagatggatcatctgggattttcttatggagaggaaccgatcttttccgattacagcgtcaggattttgcccaataccctgacagcgctttctggaccaagcggatgtggaaaaagtacgttctttcatttgctgttgcggtttgagaaaccggattctggaacgattcgcgtcggaggaaacgagatctggtgttatccgaaggagacgtacgcaggactggtgacttgtgtttcacaacagccgtatctgttccatatgtcaatctatgacaattttgccctggtaaatccggatatggatcagattcgaaaggcgtgccgggacgcagagatagatgattatatcatgtccctgccgcaagggtatgagacgattttgaaggagggaggaagtaacctttccggtggacagaggcagcggatagcgatagcaagggcacttttgaaaaatgcgaaagtccttctgttggatgagattacgagcgcattagacgaggcgacggcggcagatgtgatgaggacagtgaccaaacttgcggaaaatcatacgattttgatgatctcacacaaagctgtagagcagaatttatgcggtcaggtgattcgcctgggcgaatagaacaatataactaatggttcattttctgtaatagaaatgagagggctgctcagttgtaaaacctgccttggagaggatataataaaattatggacaggaggtacggaaaatgaatataagtgagcagatcagaaattatagaaaaagtgtggggcttacacaagagcaggttgcaaacgccctgggagtttctgcctcggccgttaataagtgggaaaaaggaaattcttatccagatatctctacactaccggcacttgccagattattacagatggatatgaacgagctgttttctttccgggaagaattgacagacagggagattggacagtttgttaatgagctttctgaagcagtattggaagagagtatcgatacggtgtttgaaatggcatcaaagaaaatacatgaatatccacggtgcgagctgttgatttatacggttgccacagtcctgaatagtgcgttgatactttctgagacagacagcaaaaggaggcgggaatacgatgccagtattcttggctggcttgagcggacggcagaaagcacgaatgaaaagatcagaatgtccagtgagtatatgttggctgtgaaatacacacaaatggaagaatatgagaaagcagatgcttatcttgccaaaattccggatgttaccattgatacaacgattatgaaaacgaatgttttgatccggaaagaaggggaagacgccgcggctctctttttagaagggaaactgatgcagacagcgacaacgcttcaaaactatctgtataagctgattgaaatagaagagacgacgggaaatcgtcaagaggcagaacagattgcggatcttgcggagcaaataatatccttgtgtggaatgtggaagtatggcggagttgtgccgcatctgttgcttgctttatatcggaaagacagcgaagggagtatcaggttgatacgagaggcgctgaatgaagcaagaaaaccgtgggacatggaagcaagcccattatattacagatatgccggtaccaggcagaagaaagcgggatctgctgctggagagagttttgtccgggcattcatttctgaaattgaaacgaaaaaagagtatgattttttgaaagagaatccggaactcgaaaagattcttgcagaatacaggaagtgacagaatgctgaaggatcctgaaaacaaaaaacaaatgaaaacgccgtaaattttcgagttgaattttgcggcgtttctgcctatactaaatcatagtaatggcatcggagatgagaaaagatgagaacatataagctgacaatctcctacgacggcactcgatatcaggggtggcagagacaacggggagtagaacagacaattcaacatgtgatagaacagtccattgcgtccatcaccgggtatgaggtgaagatacagggatccggaaggaccgatggcggtgttcacgcgctgggacaggtggcaagtctcagactgtccgggaaagtcgaggaaagggaatttcttcggaagttgaatgagaggcttccggaggatatccgtatccgggaaatcgagctggtaccgaatacctttcatggacgcagaagcgcaaagggaaagtgttatgaatatcatattgatctacgggaaaagccgtgtgtcttttcaagaaaatatacataccactacccggagaagctggatatcgaggcaatgagagaagcggctggatatttgattggacgccacgatttttccagctttacagaccgcaaggatgaggaaagctgtatgcggcggatcgacgaaatccgagtcgaggtagaaccagataagctttatctggtttttcgggggaacggatttctgtaccacatggtgcgaattttaagcggaactcttctggaagtggggagtgggaaacgtcgggcagatgaattgcctcggattctgaatgaaaagaaaagagcagaagcaggatttttagctccggctcaggggttatttttaaaagaagtattttacagagatgaaggatagaaaatatgcagggggaatcatgggaaaaagatcgcatgggttccccctgttcaggctatagtgcctttttcagatagaccatatcgacaagctggatcccacattcaaagattgggtgatcgtagttgtccgtaaagaagttttttatccggtgggattcagtaaacccgcattttttatagaacggtacggtaagcgggctgtccccggtccctacatacatcgtatggcacgatccggaatagacatctgtcagataatctatcatctgttttccgtagcctttgccttgacagtcctcgtagacggcaatatttttcagctcgcaggagccgtcatctcctggggtaacgacgcagacaccttttaagtcgtcatcgtatagggcgtacatatcgccctcatccagatagcggtcaatcatgctttcctgctcgtcggcaagcaaaagcagatcgaggaaccgctttttctgctccgtaattttttcaattttcatatgatgttgtcctccatctccctttagcacgctagcaaactcagtatacaataaagaagagaagaaatccacttcttttcagagtcaggagacacgcgaaaaagaaaatgacagggaaagaatgggatgatataatgcataagaaaggacagaaaaaagaaatctgatttttaaagaagctttgtgttttaaacgattttatgttatcagataaaaataacgatacaggaggaatggaagctatgaaattgatatcatggaatgtgaacggaatccgggcgtgtgtgcagaaaggattcctggatttttttcgggaggcggacgcggatattttctgtatccaggagacgaagatgcaggagggacaactggaacttgagcttccgggatattatcagtactggaattacgcggtgagaaaagggtattccgggacggcgattttcacaaagagggagcctttgaacgtgcggtacgggatcggtatcgaggagcatgaccaggaaggccgtgtgatcactctggaatatgatgatttgtattttgtcaccgtgtatacaccgaactcacagaatgagcttgcaagactggattaccggatgcggtgggagacggattttctggtttacttaaagaagctggaagagaaaaagccggtcgtattctgtggggatctcaatgtggcggcagaggagattgatctgaagaatccaaagacaaatcgtaaaaacgctggatttacagatgaggagagagacaagttccgcactctgaaagcgtcgggatttatcgatacgttccgctatttttatccggatcaggagggcgtttattcctggtggtcctatcggttcagcgccagaaagaaaaacgcagggtggcgtattgattattttgttgtgtcggaggcgttaaagggccggttgaaggacgcgaagattcacacggagattcttggaagcgatcattgtccggtggaactggacatgcaagaataggaggggacgatgtttgatttgcggcagtatctggaggggttggatttgctttattcctccgggcagggaaatgaggccgaagcttatttgaaaaaggggttgaaacaggcggcggcagcgggtgagaacggttcgattcttgctattttaaatgagctcatgggatattaccgtgcggcaggccgttatgaggagtgtctgctctgcgccgatcaggcaatggagcttgcggacgctatgggtctggccgggacaatggaatacggcacgatgttgttaaatgtggctacgggataccgtgcggccggaaactatgcggaggcggaagcgttatacagacaagcgcacctgattttccgcaaacatgtaaccgggccggattatcgtatggcgtctcttcacaataatctcagtctcctctacagtgagacgggaaggcttgacgaggccaaacaggagctggaactggcgatggatatcatccggaaactggatgatgcggaaatcgaggtggccattacacacacaaatcttgggaatctctgttttcagatgcaggagatagaagaagggaaacgtcacatggagatggccgtacggatttttgaaaagacccgggacgggaaagattcccattttgcgtcggcactttccgggcttggggaggcctgtttccacgaaggagatctggaatcgtctgcgaactattaccggagagcattaaaagagatcgatcgtttctacggggaaaatgagtattatcgggtgacaaagcagaatctgtctctggtgtcagatctgcttgggagaaagcaggcggccgaaaaaagtaagatgaaaggaatggaacttgccagagcctactatgagaaatacgggaaaccaatgattgagataaagtttccggactatgcggggcagattgccgcaggactgtgcggggagggttcggagtgtcttggatatgatgacgttttgtccacggaccatgattttggcccgggattttgcctctggctgacaaaaaaggattaccggaagatcggagcgcggcttcaggaggcgtatgaagcgcttccgaaagaatttctgggatataaagccagaaatacgacttcacatggtcaaaaaagggtcggcgtgtttgaaatcggagcattttttgaagaactgacaggatacaggaaagcaccggaagacgatgagagctggctctctattacccaggagaatttgcggactgctacaaacggagaggtctttgacgatccacttgggaaattttcaaagcgaagagaggggtttttaagggaaccagagacagtgcgcttaaaaaggctctgcctttctctgggacgtatggcgcaggcaggacagtataatttcccgcgggcgaagagacgggaggcgattggagccatgtacttctctctgtccgagtttattcaggcatcgacagagacagcctatcttttgaatgaaacatacatgccgttttataaatggaagataagggggatggagacatttcggaggataccggaactttgtacactgttggaggagttgatgcaaaaagatctgagggacaccggggtagaaaaaataattgagcagatctgccggatggttgtcggagaactgaacgctcagggaatttctgaccggaaagaagtctttttggaagaacaaaagggagcagtctttgaacggctggttttgatggaaaggaaaaagggacaaaaagatgactaagaaagagcggttcattgaggctgtggtggatatagaatggatacagttccagcaggtacataatgaaggaggaagagcctcctgccaggatgaccgggagacgtttgagattatgaggaaaagccagttcttggcatggacagaagaggtgctggaaagctatcttcaggatcttcgggatgcctggaaggaaggatggaatcttttgacagagaagtatgccagaatgatggagagcacagcgccggaggaatacgagcgtttccgggaaatccttccgaaaagaagcggcaagagaatccggatgcaggaagagctgatcagccaggaaatatggtgggccgaagacttttccaggcggtttccgaatcttggaggaaccggaagaaagatttatacctctgaggatacgccgtgggacacctcgcaggagacgtatttgaggggagagatcagcacatattcggatcggacgattgctctgtacgccgcaatgatcagggagatggaggaacggggagaaaatctgacggagcaaattctaggatttatggtacgtttctatggatacgattctctggaacaggcagaagagaagacagcggaaaacaggaatctatgacaagaaaagcaaaggtcaaaaaggagacaggatagaatgttgattagaagagaagacgtggtggctgtagccgtagattatcaggagcggctgatgccggtgatgcaggaaaaagaggcactgctggctcactcggtgattctgctgagaggactgaaagaactcggagttccgatttatctcacacagcagtatacaagaggacttggtatgacagtgccggaaatcgtggaagccgcaggaaccagggaatacctggaaaaaatcagttacagtgcggcggaagaagtgattccgaagctgggtgggaagaagtcagtgattctctgcggaattgaatcccacatttgtgttttgcagacggtgatcgatctcaagagcagaggctttcagcccgttcttgtgacagactgcatctccagcaggaaagcgcgggatctggaaatggcgctggaacgggcgagactggagggcgctatccttacaacctacgaagcgcttctgtttgaactgctgggaaaagcagggacaacggaggcaagaaagatacagaaattaattaagtaagagaagaatggagaggaaaagaggatgtcggctgttatcagcaggacagtcctctttttgtataccttgaaatcttaattcttctccgacaccggtccggtagaatttctcaccatcaatttggcatgcagcaacagtgtgccgatggagacactgtttctcagactgtccagcgcatagtagccgcatttgccgatctcggtccgctcctggcggacggtagtcatcggtgggtaggtgtacgggcagatcggcagatcgtcaaaaccgatgatgcttaagtcatccgggatgcgaattccgaactgttggcactggatcatagccgcgtttgccagtagatcgtgactgcagataatggcggtcatacccatctgaatcagacggggcagatgcttctcaagacattggctgatatagtaggatgccccggcaaagtcagaatcggcacgcaggccgttctgccgcatggcctggaagaacgccttatgacgtacctgcataatatgagagccaagggctccgcttaagtatccgatctttttatgtcccagttcttttaagtgggagacggcaagctccatcccctcattgttgtccacaccgacataggctgttctgggattggttttgatatagttgtcatacagtacagtgggggtactgctcgtctgaaaatctgtcatccatggatcctgaagagtgaatccaagggcaaacgcaccgagataatcgtgctggagcatgaacatatcataagagatggagcgctgcagcttctccgttatcgggaagatctcaaccaaaaatccggcgggctccgccatctggcggaatccggtaacaatatcatagccaaactggtgcggctcctcgtaatccagattttctacaagaatacagagtttctttgctgtctgcttctgtctgcgccgtctcgtatatcccatctcgacagcggtttctaatatcgtttttcgcaatgtttcgctgatatccggagcgccgttcagcgccttggaaacagtacccttggacacgccaagcttctcggcgatatctaaaattgtagccatacaatcacctttctgaagtctaaccatgaattcacctgttttctctattataccgaatacttacggaaaatgcaatttgttttacgaaacttgtaaaacaaaagtttcgatcgccgaatgaagaaaagaaagaaaaataattgtgcaaatgatataaaaatgaggacttttacatgtgaaaaacagagaaatgcatggttgaaaacgagaaatagggttgacgaaccaaaatagggcatgtatagtatgtcttaacgaaacaaaacgaaactttcggaaggagaggtcagaacgatgaagagaagagggttggcagttttgctggcggcagtactgggcgcatccatgcttgccgggtgcggaaacagcgaagatggatcgtccggcggaaagaaaaaagtccgtctgatggtctggtccccatcggaggatcagtcaaaggacagtggagaatggcttcagacgacgtgtgagaaatttgcggacgaacatcccgaatgggatatcacctttgtctatggtgtagcggatgaggcgacggcggcaggccaggtagcgcaggatccggaggcgagtgccgatgtgtttatgtatgcaaacgatacacttaccacgatgacggatgcaaacgcattggtgaaattcgggggaaaatacagagaggagatcgaaagaacaaataccgaagaagtcatctcatccctgacaaagaacggggagctttacggtgtgccgtttacgacaaacacctggtttatgtactatgacaagagcgtatttgacgaagaggacgtgaaaaatctggatacgatgctggaaaagggcgttgtctctttcccgatgacaaactcctggtatcttccggcattttatatcggtaacggttgtaccctgttcggagatggaacggacgaggcaaagggcgtggatttcgggggagagaaatccgtggaagtgacagattatcttgtagatctggcgggaaatccgaattttaaaatcgacgccgatggttctggtattgcgggacttcgtgacggaagcatttccgccatgttttccggttcctgggacgccaatgcggtgaaggaggcgctgggtgataacatgggcgcaatcgctcttccggcttatacactgaatggagaggaaaagcagatgatggcttacgccgggtccaaggcgatcggtgtgaatccaaactgcaaagatatggtagcggcggtagagcttgccgtatatctgggatctgcggaggcgcagcggacacattatgaactcagaaatgtgatcccatgtaacacggaacttctgaaggatactaaaattgcggaagatccgcttgttatggcacagaataatactttcaacgacacatcgattcttcagccgtttgtcgccaagatgaataattgctggactccggttgaaaacatgggaaaaggaatccgcaacggcagtgtgacacatgacaacgccgcagagcaggcggaagcgatgaatgaggcaatgaacagtgatggaatctaaacgaggtgagaagaggatgggaataagaaaaaagcatgtcaatgaattcccgacaccgtacacctgtacggcggcaatcagggaaggcggcatggagacgaagctctctatggtgctgatgggatttggaaatatcatgcataaacagaagatcaaaggactgatctatctggcagttgaagtagcgtatgttgtattcatggttttgaatggaatccgtttcctctccatgcttgggacactgggaacagtagaacaaaaagaggtatgggatgaggtgaatcagatctatacatacacaaagggtgatcagtctgttctgatcctgctgtatggggtggcaacgattcttgtgacaattctgatgatctgggcatggcggggagcattaaaaagcgcgtacaaggcggaatgtctcgacagggaaggaagacatgtgaacagctttgtcgaggacgtgaaagcactcctccacgagaatctgcaccgtcttctgatgacacctccgatggtgtttatctttgcgctgaccatcctgcctttgatctttatgatctgtatggcatttacaaactacagtaagatcgacaatcacctgatgctgtttgagtgggttggtctggataatttccgggcgctgtttgattccaacagtattctgggaagtacattttggtctgtacttgcatggacgattgtatgggcgttctttgcaacgtttagtaactatattttcggtatgatcctttccatcgttatcaaccggaaagagacaagagcaaaaggattctggagattctgcttcgttctctcctgtgccgttccgatgtttgtctcccttttgattatgagaacgatgcttcagccggagggagcggtcaacgtgttgcttcggaatctgggactgattgcacaggacgccagccttccgtttttcacggatccgatgtgggcgagggtgactgtcattgtcatcaatatctgggttggtgtaccgtatacgctacttcagcttaccggagttcttcagaatattccgggagaactttatgaagcggccaaggtggacggagcaaacgcggtgcagatcttttttaagatcacgctgccgtatatgctttatgtgacgacgccgtacctgattacaacatttacgggaaatgtcaataacttcaatattatttacctgttgtccggaggagatccggttacggatctgtcctctacagcaggaagtaccgacttgcttgttacctggctttacaagctgaccattgataagcagtactacaatatcggtgcggtgatcggtatcctgacatttattattctggcgattgcggctcttcttacataccgcaacagtaaatcatataaagaagaagggggattctaaacatggctgctggaaaagtacgttcagctaaaaagagacgtttcattcataatacgatcgtacatgtcgtacttgccattttggcgttgatctgggtattcccgattttatgggtaatactgacaagcttccgggcagagaaggggtcctatgtttccactttcttcccacagagctttacactggataattatgtgagactgtttacagacacctccattctgaactttccacagatgtttgcgaataccttgttcatcgcggtgtgttcctgtattctttccacattttatgtgctggcggtatcttattgcctttccaggctaaaattcaagttgcggaagccttatatgaacatggcgatgatcctgggactgtttcccggattcatgtccatggttgccgtttactttatcttaaaggcaatcggactgacagaagggaatctgatcaaagtggcgctgattttgtgttattcaggaggcgcggggcttggattccagatcgcgaaaggattctttgataccatcccgattgcggtggatgaggcggcgcttctggatggatgtacgagatggcagattttcagtaggatcacactgccgcttagcaaaccgattatcatctataccgtgctgacgtcgtttatggctccatggctcgacttcatttttgccaaagtgatctgccgtgccaactccgaccagtacacgattgcgattgggctctggaaaatgctggaaaaggaatatattgacagttggtataccagctttgcggcaggagccgtactgatttccattccgatcgcgatcctcttcctgtttatgcagaggtactatgtagatggtgtatccggagcagtgaaaggctaaatgtgaaaggcaggcaaaacagatgaatgaggagtgacagatgagaaagacagcaacagaatggaaggcatattattcggatccgaaatttgaacaacaatatacctatgagggacatgacctgggtgcaacctgcacggaggatggaacttccatcctcctgtggagcccggttgcagagacggtgaatgtccgcttcttccaggatggtgagacagggaaaccttatcgcaccgaggttatggaaaaggaaaaacaaggcgtctgggcttaccggacaaaagaaatgctccacggcgtgtactatgattttgagctcgtaatcgagggggaggcgatcaggtcagcggacccttatgcgaaagcgtgtggaatcaatggacaaaggagcatgatcgtagatttgaaacagacagacccggacgggtggcaggaggaggtatcccctgaaatgcagccggagcaggtgatttatgaggtgcatatcggggaatattcctgggatccgtcgggaggatttcccgaagccttccggggaaagtataaggcatttacctgtgagaatacaacacgaaaccatgacggtgtgcatcccacaggcttttcttatatgaagagactgggcgtcacccatatccagcttatgccggcatacgactatggatctgtcgatgaatcgaaggaatcgggggagtttaactgggggtatgatccggtaaactataatgtaccggagggctcctacgccacagatccacgaaaaggagaggtacgcatccgggagttcaaagagatgataaaggctctgcacaaaaacggctttcgggttatcatggatgtggtctacaatcatacttatttcctggattcctggtttcagaggacggtaccgtggtattattaccgtgtccacgagaacggagagacggcgaacggatcagcttgtgggaatgatgtggcgagtgagcggatcatgtgcgcgaactatattgtggattccgtgctttattgggcgggagagtaccatattgatggattccgttttgacctgatgggacttctggacaccggacttatgaaccggatcgagatggagctttcttcccgctatggaaaaggcgagaaacttgtgttcggggaaccatggtcggcaagtgaaacacccatggaacaagaagctcttccggcactcaaaaagaatatagaccggctgaatccgcaggttggatttttctgtgatgatacaagggatgccatcaaggggcatacctttgaggggaaaacgcctggatttgtaaatggaggaaagggacaggagggggcgattctctcctcggtgaaagcatggtgcggaccgggatccaaagtccaggcgccatcccaggtcgttacctatgtatccgcccacgataactggacactctgggataagctttctcttacagtggaggatgaggcagagaggatgcgtgccaacaggatggcggcggcggtgtacatgacgtgccagggcaggattttcttcctttccggggaagaagcgtcccgcacaaaaggaggactcgaaaattcctacaacgctccgattgagatcaaccgtctcgactggaaccggatgtatgaacagtatgagctggtagaatattacagcggtctgattgcacttcgtaaacggctgccgggactttgtgataaatcaaaggatgcgtggaaacggatccgggacgagtggaaaacggatggggtcgttggctttctcgtggataaccacagcgagagccagccgtccctgtgggagacactttgcgtgatttataatagcagacaggaagaaatcgagcgaaaccttccaaaaggaaaatgggaagtgcttgtagatgcgcacagcagccgcctctggcagaatccgtttgtgacagaaggaacgatccgggtggaaggacgcagtgtcctggtgcttggacagacaggaaaggaaggctagacatatgaaatggatctacgggaaacaagatatcaaaacgcttgaaagagggcaggagaactgctatcttctgacaaatgggctggggggcttttcttccctgacaatgatcggatcagcggccagaaatgaccatgccctgctgatgggatgcacccaggcgccgaaccaccgctacaatctgattcaccgtctgcgggaagtgttggagacgaaaaaagagaagaaagtgctttcttctcaggagtttgatggcggtacggcggaggagggataccggtacctatcctccttcacctttgaggatacgcctgtctggcgctacgaggccggcggtgtacaggtaagaaaggaaattgggatgccgcacatggaaaataccgtggcggtggtctatgaaatagaaaacgagacactggaagcggtcacacttcaagtcactccattcctccaatttgtgagaaagggcgaggatctaaaggaagagcagaactttcagtgggatggaaattcggtcatatcgaatgggattgggctcttctttgagaccaatggagagattttacagaaggaggagacggaaacctgctattacagttatgatgtctgcgatggcaggcggccggcaggcaggacaaaggcggtgcttcagatcagcctgagagttccggccaggaagacggggcggctggagatcatcgcttcgacttgtgctggaagaaaggatgcggaaggtattcttgcggacacgaagcagtaccgtcaagaactggaagagcgggcaggatttacagcaccgatggcaaaggtgcttgccaaaagtgcaggacaattcgtttcccggagagagtctacggatgggaagacgattctggcaggatacccgttcttcgaggattggggcagagatacgatgatcgctcttccgggggtctgcatttccaccggacagtatgagactgcaaaagagatcttacggacctttgccgttcacgaaaaggacggtctgatgccgaacctttttccggaggggaagaatgagccacggtacaatacagtggatgcggcgctgctatttatcaactgtgtctacctgtattaccaagcggcaggggatctggattttgtaaaggaagtctggccggtaatggagcgcattgtggcaaactaccaggcaggcacgagacatggcatccgtatggatgaagacggtctgattttggccggggaagggctcgatcaggtgacgtggatggatgtccgggtaggagatttgcttccgacgccgagacacggaaaaccggtggaagtcaatgcctactggtataatgctctccgcattatggaaatgtttgcatctgaactgggaatggaatatactgggtatggggtgctctcggacaaggtccggacgtcatttcggcagcaattctggaacgaggaaaaaggctgcttaaaggatttgatctccgggacgaaggcggatacgcagatccggtgcaaccagatctgggcggtatccatgccgtttggtatgatggatgaagagcaggaacggcaggtcgtgcggacggtctacgagaaactttacaccccttacggactgcggacactggaagaagcggacgaggagttccatccgttttacggaggagaaatgatcaagcgagatctggcatatcaccagggaacggtgtgggtcttcccgcttggggcttattatctggcgtatttgaaagtacacgggtacagtgaagaagccagacagcatgtccgaaagcagttggaagtcatggagagcgccatgagggaaggatgtatcggacagcttccggagatttatgacggaggaaacccgacctcatccaaaggatgcttcgcccaggcatggagtgtgggcgagatcctcagagtgtacgaggcggtcgaataagaatctacatcgaaaggagaacgaagatggaacagttattacaggagatgttacagaagaactatggaaaaaacattcaggatgcgtccaatgaagaaatctatacagcacttttagagattacaaaagaaaaaatggccgggatgaagagaaacgaaggcagcaaaaagctctattacatttcagcggagtttctgatcggaaaactcttgtccaacaatctcatcaatctgggattatttgacgagacaagagaagttctgaaacgatatgataaggagatcaccgagatcgaggaagtagagccggagccgtctcttgggaatggagggctcgggcgtttagcggcctgctttctggattccatcgccaccctgggacttccgggagacggcgtaggattaaactaccatgacggattattccgccagacttttgtggacaacaagcaaagagaagagaaaaacccgtggattacggatcagagctggcttacaaagacagagcgccattttgaagtgccgttccagaatttcactctgacctctacgatgtacgacattgacgtaccaggataccaaaatggctgcaacaaattgcatctgtttgatctggatactgtggatgaatcaatcatccatgatgggattcagtttaataaagaggatattcggaaaaatctgacacttttcctctatccggatgacagcgatgaggcgggacagcttttaagaatttaccagcagtattttatggtcagcaacgcggcgcagcttattctggcagaagcagaggaaaaagggaatgatctctaccacctgtatgatcatgtggcaattcagatcaacgatacgcatccgacgatggtgatcccggagcttattcgcctgctgatgcagagaggatttaacatggatacggcagtggacgttgtgagaaagacatgtgcttacacaaaccacacgattcttgcggaagcactggaaaaatggccggtatcttatctggaaaaggtcgttccgcatctgatgccgattatccgggacctggacgcccgtgtgaaaagagatttccacgatgagagagtatatattatcgatggacaaaaccgggtacatatggcgcatattgatattcatttcggatatgcggtcaacggtgtggcagcgcttcacacagagattttaaaagagtctgaattgaagccgttttacgatatttatccggagaaatttaacaataagacgaatggtattaccttccggagatggcttgtacattgcaatcacagattatccgattatctgaccggactgattggaccggaatttatggaggacgcctcccatttggagaagcttcttgcttacaaggacgatgagaacgtactggcggatctgaggaccatcaagaaagaagcgaaggcagagctgaagaaatatcttatgcagacacagggtgtggagatcgatgaaaattctatctttgatatccagatcaaacgtctccatgaatacaagagacagcagatgaacgcgctttatgcgatttataaatacaaagagatcaaaaaagggaatctgccgaaacgtccgatcacgatgattttcggagcgaaggcggctccggcgtacacgattgccaaggatatcattcatctgcttctctgtctgcaaaagctgatcgagaatgatccggcggtacgtccatacctgcggattgtgatggtagaaaattacaatgtcaccaaggcggaaaagttgatcccggcctgcgatatttccgagcagatttcccttgcctcaaaggaagcatccggaaccggaaacatgaaattcatgctcaatggagccgtgacgctgggaaccgaagacggggcaaatgtggaaatccatgaacttgtaggcgatgacaatatttatatcttcggggcaaaatccgaggaagtcatccgtctctatgatacaaacggatacaactccggcaagatctacgatggcgacgccatgatcgaggaattggtggactttattatcagtaaagacctgatccgtatcggagatccggtgagccttgcgagactttacaaggaactggtttccaaagactggtttatgacacttctggatgtgaaagagtacattgagacgaaagagaggatgctggcggattatgaggacgagctctcctgggagagaaaagctcttgtgaacatcgcgaaggcaggattcttctcatccgaccggaccatccgggaatacaacgatgacatctggcgtctgtaggccggatgcagcaggaaaggaaagcagccatgagagaaacaggaattttaatgccggtttccgccctcccgtcccgtacgggagtgggggagctcggagcatatgcatatgagtttgtggaggctctgggggaaaacggggtgaagatctggcagatcctgccgctcaatccggtgggatacgggaactccccataccagccatactcctcctgcgccggggacgaaatctatatcagtctcgatcttctgtttgaagcgggactgttaaaagaacaggcacctacattccacgagaatgtcagaacagtggattatgatgcagtccgtacttttaaagagccgtatttgaaagaggcattttcaaactttacggagacagaagattttagggaatttacgaggcagccatgggtctacgagtacgctgtattccgtgccaagaaaaaggcgaaccacaaagtctgctggaatgaatggaaagaagaggataagatctggccggaagttccggcgccgctgccaaaggagcaggaggacgaagcggcttaccagatgttcctccagtacgagttctacctacagtggatggaagtaaaacggcgtgccaacgaaagtggtattcagatcatgggagacgtgccgttctatgtgggtgtggattctgtggacgtctggggtggaaaggacaatttcctcctggatacagacggccggccggttttcatcgccggagtgccgccggattatttcagcgccaccgggcagagatggggcaatccaatctatgactgggactacctgaaagatcacgaataccagttttggatcgaccgcattggttacaaccaaaagctttttgatatcatccggatcgatcatttccgtgcctttgacacattctggaagattccggcaagctgtcctaccgccattgagggcgagtggatcgaggctccgggatatgaggtcatcgatactcttcgggcaaaaattgacggcttaaatcttgtggccgaggatctgggtgagcttcggccggaagtattgcagttgaaggaccattaccatttaaaagggatgaagatccttgtattctccatcgagacgggtggaaaatatgcatatgatagtttccatgatgtggaaaacatgattatctacaccggaacccacgataatgatacccttatgcagtggtatgagggattgagcgtagctgccagaaggaaggtgcgccgtttcttaaagcgggagggcatcaaacagggatctgtaaaagaccgccttctgacatatacgcttcgcagcaaggcggaatacgccattcttcctatggcggatcttctcggactgggagcggaaggtcacatcaacacaccgggaacggtgggctccccgaactgggagtggcggatgccggattttggacaggcaaaagaagaattaagaaagtaccggagagcaatgacagaaagggtttgatgacagatggattttacaggagtttaccatagaacgacagagcaaatgagttatcctttgaacgaatcggaactgatcgtcaacttaaagaccggatatgacgtaaagcaggttttcctttattatggggatccgtttgaggcggggattctgggaggaaaagagacgtggaccggaatccgggaagagattttctacaggaaacggctgaagcatcagatctggtggacgacaaccctggtgccaaagtataaacggtgcaaatattattttgaattacatacggatgatgagatctggtactattttgaagacgggtttctgacaaaagagcagatggagatggagggaaggatgcttcagtgctttaccgtcccatggatgaaccctgcggatgtgaaccggacgccggactgggtcaacgacacgatctggtatcagattttcccggaccgcttttgtaacgggacgccggaagatgacagggaaggtatccttgcgtggaagaatgaaggagcagtcacgaacgaggagacctatggtgggaatctggaggggatccgccagaaacttccgtatttgcagaagcttggaattacgggtatctacttaaacccgattatggaggcagattctaaccataagtatgatacgaaggattatacaagaatcgatccgcagtttggggatgccaagacgatgagacatcttgtcaaagaggcgcatgaacacggaatccgggtgatggtggacgccgtgttcaaccattgtggacagaatttcgcgccatggctggacgtaaagaaacacggggaacagtccccttatgcgggctggtttatggtgaatgactgggagcagatgaataaggaggcaagtaccagggacggacgttactattcttttgcctttgcggacaagatgccaaagctgaacacgaacagcgaagaggtcatccactactttcagaacgtctgtgagggctggattcgggattatgacattgacggcatccgctttgatgtgggaaatgaagtatcacaccggtttttaaagcgtattcggaagcatgtgaaagccatgaagccggatatttatcttttaggagagatctggcacgatgccagccaatggctcatgggggacgagtatgattccgtgatgaattatccgctgatgagcggaatccacgattttttcatcgacaggacgatgaaaaaagaggactttgagtatatggtgaatcactgctatacgatgtatatgcagcagtccaacaatgttctttttaacctgctggattcccacgatacagaacgtctgatgaaccggttccgggatctggatatcttttatcaacagttggcggtcctctttaccatgccgggaagcccgtgcatctactacgggacggaaatcgccatggaaggaagctttgatccggactgccgcagatgtatgccgtgggacaacctgcacaccgaagaaaatcagcgtcggatccacgagatccagaagcttatccacctgcggaagacggagccgtcattcaaaagcctgtactttcacttcccggaagaatacagagacgaccggcttgtacactatatcaaactcgaccgcaatcagaaccagatcgaaatccttctgaactgtgctcaggaggacgttacgctacaggaaaaaggagagatcttgttccaaagacaatataagaatggaagattatatccaaagggtgtactgattcgcaggagataaccgaagtggtatatagcagatttcaacggggacatattccgatgtatgggaatatgtccccggttttgttatctgttgtttttttattgctattttttgtgtatacttttgtcagaggtgaataaacatgggatataaaatattactggcagatgacgacagggatctgctggagatgctgggacggtattttgaaatgaaaggctatcagatattgcaggcgggtaatggtacggaggcagtccggatgtcggccgaggagccggatttgattctccttgatattaatatgccggggatggatggcctggaggtatgtcgaaagatccgagggcaggtatcctgcccgattttatttttgaccgcgagagtggaggagcaggaccgggtgaatggtctgatgatgggtggggatgattatatcataaagccgtttagcttgaaggagctggaagcgagagtacttgcccatctgcggagagaagagagacatcagcagaagacacggtaccggtttggaaacggacttctggtagactatggagccagagcggtatggattgacggaaagatgctggatctgacaaagacggagtttggaatcttggaattcctttccatgcatccgggacaggtatttgataaagagcggatctatgaacatgtatgtggatttgacggacaaggggacggccgtggaattacagaactgatccgcaggattcggaaaaagatcggtgagtttacagacgaggatccgattgagacggtgtggggagtgggatatcgatggaaaaagtaagaaatctttctctgcgtaaaagtattttgctctacatggcggtaggaattcttgcaggatttctgttgggcgccattgccgggaatgaggctgggcggatacaggagcagatctggtggaaatacgtggatcaggatcgatacatcgaagaatttctcaaaagagatgaggaatcttttgatgtggtgattccaagggtcagtaacagcagaatgtcagattgggacgcacgcttttctgagtggtgcgattttttacagacttatggaattcttgtcatgtgcgcgggtgggatcattgtgtccaccatgctgttttatcaaaagaaaatccggaaaccactgggaaccctccggatggcggcagaaaagattgcaggcaatgatctggactttgaaatcgggtatgaaaacagggatgaactgggagaactctgtctggaatttgaccggatgaaaaatcagcttacacagaacaaccggaaaatgtggcggatggtagaggatgagcaggttctgcgtgccgccatcgcccatgatatccgaaccccgcttactgtgctcaaaggataccaggagatgatgctggagtttttgccgggggagacgctggacagggaaaccctgcttcatatgctctgcgaaagtatggggcagatcgaacggctggaacggtttctggagcggatgcgtgctttttctgctctggaacaacaaccgctttcctgtcagccgcaaacagtggaaaaactcagcgaggagattcagaaggtgggagaaattctctcccgggaggcgaaacgagagtttcagatttttgcgggcggcaaagggaagacactctttcttgatcgggatctgattctggaggtggcggacaacctgattggaaacggactgcggtttgcaaaaaggcaggtgatagtctgtgtattggaggaggagagtggactgaccctggaggtaaaggacgatgggacaggctttgacatcagcgaggagagggcaaagcaggcctttacgacctctggcttgcgggacgatctgaagcattttggtctcggaatgtatatcagcgagctgtattgcaagaagcacgatggttttctgacagtggagaatcaaagtggcggcgcctgcgtgcgtgcctatttccggtcgattgtaccggaatctgttgtgccggaaacggaagcattttaaaaagaatcgttcttgttgtgttttggttgtgaatcgaatgataccatcatcttatcaagaaaagaaagaagggataagatgaaagggatgatccggcaggaactgaaaaactatttcaaaaacccactttactgggtgggtatcctattcattctttatgggctcttccagatcctttctccgtatctggacgtacattatttccattctaagcaggaggtacagcagacgaaaccggaatcgctcgcggatgcggatatcatggacggctatgtcaagtccacggaaaaggaacggatcgatctggcggcgaaaaagatacagagtatgattgtcaaagaatttggcgaggatgcggaaaatgtgcgggagacgctaaaggaaattcgggaatcagggaagtccgtatctgagatgtccgatgcgatcggggagatctatggatatccgaaaggttacagttttcagtattattaccaggtgtatgagtatcacaaagggacaaaaaatgagatcaacaaagatctgaaagaaaagcttacggcccacagctattcctggtattttggcaggaaattcgcggattttggaggattataccttggatttttcagtgcggtgctacttgcgttcctctttatccgggacacgaaaagagacacctacgagctgcttcatacgaaacctgtcactgccaaggcttatgtatttgggaaagcggcaggcggctttttctccatggcggcggcttggcttctgtttgtggtagttttttttgcgctgagtgctgtcgctggaatccgaaacggtcttccggtttcgctgatcgaatttctgatcccggcggtctgctatatgctgccaaatgtcctgatgatcgtaagcgtctatactatcattgcgctgggctttcgaaacccgcttccgggtgtgccgtttttgtttttgtacctgatgtactccaatatggggcctttacgacctctggcgattacagtacggttcgacggcggttttctggaggcggtggctccgagggcggtgtataatcaggtgtttcttctggttgtttcggcaggactgctttttatggcgtccgccatctggaaaaggaggcgcataggatgaaaaaggaaataaaaatctgtatgtctccgtacaaaatcgtatattccgtgttgtttctccttttgttttccctggcgatgggagttgcggtgattccggaaatcggccggaccattatcccgggggcagcaattcttgcgtttgtattttgtgcggagacaagggtgatggatcaaagtggtcagcggtgggagatctttctcctcaagcccctgtcaggcaggatctgcacgatttacagaagatggttgattcaggtcttgtatttatatgttctctttctggtatggtattttgtctttttctggcagaatccatatcccatcagggagcgtccacttgaaacagagtatgggtactatgccgtggcgcttcttgggacgattctgttttggagccttttaactttggttatttccaatgccgcaaagagccaatggatcggaatcggagtgtcggcggtagtctggatcatcaccaattccaaaacaggagaggcgctgttcggacggtacaatctgttcgcatattcggccagtcatcctgtcaagggaaagacggcggactggatctttggaacaatgattcagatagcaatagcggcactgtttgtgctgctcattccatggatagaaaagagggtgtcaaaatgagtatagtcatcaaacaagtgacagtagaatttaaaaatcacgtccgggcggtggatcaggtagacttgacgattcccagagggatctacggcctgttaggggaaaacggggcggggaagacgacactgatgagagtgctgacaacagtgcttacgccaaaggagggagaaatctggttggatcacatccggtacgaaccacagcagtatgaaacgatcaaaaggaaactgggctatcttccgcaggagctgaatctttatccgggactttcggtgagagaatgtctggaatatctgggagaactctcccaaattccgaagaatatttgtaaaaagagaattgatttttatctggagaagacggggcttttgcctcatcaaaaaaagaagatgcgccaactctccggcggaatgaagcggagagtggggctcattcaggcaatgcttggcgagccggaatttctgattgtcgatgagccgaccacgggcctggacccggaagagcgggtgcggatccggaatctgctggtggattttgcgaaagggcgtacggttttgttttccacccacgtagtagaagatattgcggcgacgtgcagcaacctggcggtcatgcgaaaagggacctttctctataccggaaccgtgcaggatcttctgaaccatgcaaaaggaaagatctggatggcggctgtctccggagaagatgaggcaagaggactggaggcaaaataccatatcacctctaaacagtacacagaagagggaatgacggtgaaaatgatcagcgatacccggccggccgtgccgtgtacccagccccaaatcactctggaggatgcgtatctgtatctgatggcgccaaaagaaacattgtaaaaggcagtaaattccaaatgaaggaatcgccagttccgataaatgccggtactggcgattctgcgcttccatattgttcttataccgtgtggaatccccgtccgataatctcgcttgtattagagatcaggataaaggctcccggttccgtctctttgataaagtttctgagacgtactgcctggggccggtttaacgccgtcaacacaatatatttctttttgccggagaaaactccctgcgccgtgtagaccgttgctcctctgtgaagatcccggatgatgaaattgcaaatcggctccgggttgctgcaaacgacgttgaagcacttggacaagttgaagctttcaatgaagttgtctgtgattacagagcgaagaaccagtcccagaatggagaagagcccggtttccataccgaagacaaacacgccagctactgcaatggcaacgtcggagagcatcaggacgcgtccgatatcatatccggtatactttttcagaatcatcgccacaatatctgtaccaccgcttgacgcccccatattaaagagtatcgcagagccaaaggcaggtactgcgatagcaaacatcagctccagtactggctggttcgtaagagggccgtccatcggatatacacgttcgagaatggacagcagaaaggaaaggagcatgctacagtaaaaggtcttggctccgaaacctttaccaagtactaaaaatccaagaaccaggagtacaatattgcagacaaagttgaaatctccgctgctgattactccggttttggcgacaagaaccgcaagaccggtgattcctccaaaagcaaaattgtttgcgaatttaaaaaagtagatcccgcaggccatgacagcggttgcggcggtcattacaacgaaatccttgacttttgaatgaggtttgatatcggatttcggttttgggatagaatatttcatatccacatggtaattactgttcattttttcttcctcgttttctttcggtttttatgaagaattttcttcaaaattgtaactccgcaggatgaaaaagtcaacgacctgtcaggggaaaatcgaggaaatctgcgatggttcacctatgcagacttgattagaaagctcatgtcagattttatgaatattcagactgtatggctgaattatgaaaggaaaaatcatgtaatactttccttacggtatggaagaaatgttttcggaaatactatggcagaaaaggaggaaatgatcatgtatcactgtaaagcgattcgagatatatacgcaagagaaatcctggattccagaggcaatccgacggtagagacgcaggtgcttttatcggacggcaccattggaaccgcaagtgttccgtcgggagcgtccacagggcgccacgaagcactggaacttcgtgacaaagaaaagcagcaccggtactgtggccgtggtgtggagctggcggtagatcacgtcaacgaccggatcgcaagggaaatcatcgggatgaatgccctcgatcagatggaactggatcgtgtgcttgtaaggctggacggtactgaggataagagcgcccttggagccaatgctattctgagtgtctctatggcagcggcgaaagcggcggctaaaagtctggggcttcccctttatcggtatcttggcggggcacatacccgtagaattccggtaccgatgatgaacgtattaaacggaggccggcatgccgacaatattatcgacttccaggaatttatgattatgccggtgggagcctgctgttttaaggaaggacttcggatgtgtacggaagtgtaccatatgctgaaagcgcagctaaagggaaaaggactgcataccggagtgggcgatgagggcggatttgcgccggatcttccggacacggagagcgtctgcgagacacttctggaagctattgagacggcaggataccgtccggggcatgacatcgtgctctgtctggacgcggcggcgtccgagatctacgatcgggactttgggaaatatgtctttgtaggcgaaagtaaagggaaggagaagaaagtcgtccgcacggcggaggaactgatcgactactatgccgaactgatcgaaaaatatccgattgtttccattgaggatgggctggaagaggaggatttctccgggtgggagctgatgaatacgagacttggtttacagacccagcttgtgggagacgatttgtttgtgaccaataccagacggctccaaaaagggattgacgcccatgcagccaatgcggtgctggtaaagatcaatcagattggaacgctgactgaggcgtttgacacgatccgcatggcgcaggaacacggataccgctcgattgtttctcaccgctccggcgagactgctgacacgacgattgcggatattgccgttgcttttggtaccggacagatcaagacaggcgcaccgtgccgatccgagcgggtagaaaaatacaaccggcttctgaaaatcgaggaagagcttggggacgcggccatctacaaacaaccattctgttaaaaaacgatttttacgtgtgacccgaaagtctgtgaaaaactgcttgcgtaaacctcaatgatatgctaatattataaatggtttatacgcaggaggtgtagaaattggaaattttgaagattgtgatcacaattatatttgtaatagactgtattgctctttcagcagttgtattaatgcaggaaggaaaatcagccggacttggaacgattgccggcatggcggatacctattggggacagaacagaggtcgttctatggagggaacccttgtaaaagttacaaagattcttgccgcactgtttatcatccttgccgcggttttgaatttaaaagtatttgcttaatgaaaaaagatgcgggacactctatttcaaagatagggtgtcctttttttgacaatggcggcgcgtcaaagtccgggcttgcctggaactttggtcaccgtttacgatcccggaatatatcttttgatacttccggtgatttcacgatatgagtatagaatagaagggagcatgctaggtgcggacaatggaccgacaatatgagaaaagaaagaaaatggtataccagttcatctgtgacgaattctatgtcccgatgaagatgaaagagatggcggccatacttcaggtgaaaaaggacgaccgccaggacttaaaggagattctcgatgcgctggaggcggaggggaagattcaccggacccagaagggcaattatatcaaggggcaggccaaccggctggccggaatctatcaggctcatgcaaggggatttggctttgtctccatagaaggatcagacgatgatgtgttcattccggaggaggagtcaaacggcgccctgcagggagatgaggttgaaatccagattacacggggcgccggaaagagggaaggacttcgccaggagggaaaggtgatccggatcataaagcgtggcacgtcccagatcgtcggatattaccagaagaataagacattcggattcgttctgcctgacaatcagaagtttctccaggatgtttttgtaccggaggagaaatcaaagggggccgttacgggacacaaggttgtggtccgtctgacttcctacggtggagacgggaagaagccggaaggagaagtggtggagattcttggacatgtcaacgatccggggacagatgtgttgagtatcgccatgtcctacgagcttccgatcgaatttccggaaaaagtaaggaatcaggcagagcgggtggcaaagcccgtaagcgatgcggaccgtgcgggcagaagggatttaagagacgtttcgatggtgacgatcgacggggaggacgccaaagatctggacgatgcggtttccctgaatgtttgcgacgggtactattatttgggtgttcacattgctgacgtcacgaattatgtgcaggagaacagtgctctggaccgggaggcgaagaagcggggaaccagcgtctatctggcggaccgggtgattccgatgcttccgcatacgctctccaatgggatctgttctctcaacgaaggggaggaccgtctggctctgagttgtctgatgaagatcaatgaaaaaggggagatcgtagatcatgagatcgtggaaagcgtgatccgggtggaccgacgcatgacgtacacggcggtgaagcgaattctggaagacggggacgaagagcagtgccggatttaccgggattttgtacccatgtttcagcagatgcagacactctctgctcttcttagggcaaagcggcatagaagaggcgcggtggactttgattttccagagactaaggtggtgctcgacgaaacaggatgtccggtagcgctgaaagcatacgaacgaaacacagcaaccaagctgatcgaggacttcatgctggctgcgaatgagacggtggcagaggacttcttctggagagagattccatttgtctatcgaatccatgaggcgccggatgaggaaaagatcaggaaacttgcggtctttcttcacaacttcggctatactatgcatgtcggaacgaacgaaattcatcccaaggagatccaaaagctgcttgccagggtggaaggaaaaccggaggagccaatgatagcaagattggcgctacgttccatgaaacaggcaaaatataccccggaaaatgaggggcatttcggacttgctactgcgtattatacgcatttcacgtctccgatccgccgttatccggatttgcagattcaccggattatcaaagagatactgcggggacggatgaatgaggagagaatctgtcattaccagtctatcctggaagaagtgacaaagcacgcaagtgagacggaacgtcgcgcagaagaggcggaacgggaaaccgtcaagctgaaaaaagtacagtatatgaaagacaagatcggtgaggagtatgagggagtcatatccggcattaccaaatgggggatgtatgtggaactccccaatacgatcgagggactcgttcatgtagcgaacatgaccgatgatcattatgagtatattgaagatcgttatgaaatgcaggggatccataccgggaagacgtaccggctcggacagaccattctggtacgtgtcatcggggcggatgaattgcagaggacaatcgactttgagcctggaaaggagagaaactaggatatggcaaagacgacaggggtaaagatgatagccaataataaaaaggcatatcacgattattttatactggagacatacgaggcagggatctcgcttgccgggacggaggtaaagtccttgcggatggggaaatgcagcatcaaggaatcctttatccgcatggaacatggggaggtctttgtgtacgggatgcacatcagcccgtatgaaaaagggaatattttcaacaaagacccactccgggtcagaaagctactgcttcacaggcaggagatcaataagctgctagggaaaatgaaagaaaaagggatgacagttgtgccgctgaaagtctatttaaaggggagcctggttaaagtggaaatcgggctggcacggggaaagaaactctacgataagcgggcggacattgccaaaaaagatcaggcaagagaggcacaaagagatttcaaaattcgcaattttgggtagattcaaatggaaaaggaaggtataatagaaatggtaccagtgacaaaaaaggatctgaggaaccttgtttcccagacaacaatagagacttatgaagagctgacaccaaagctgattcagttgattgatatgacaaagaaaaatccggatttgacagacgcgcagaaatcggacgagatttccctgcatatgcttggctatgtcaaatcctgcaccaacgagattatcattgaggtgcttgcagaaatactgggactggaagatgaagaataaataaaatacaaaaggggaggccgacgcatggtacacgagatcattcctgttatgatcggggaagaggaaacaaacgcaagactttatacatatttctggagtaattccaaagagctttatgatggacggagaagaccctgcgtcctgatctgtccgggaggcggatatgcgatgacttcggaccgggagggggaaggtctggcagtacggtttatggagatgggatatcatgcggccattctccgctattcgaccgtgccggacgcagtatttccagacgcgtttttacaggcgtcggcctgtatgaaaatgctaagagagtgtgccgataaatggtttattgatccggagcggattctgattcaggggtcttccgcgggcggacatctggctgctatggtatctacctactggcacagtccggagcttgccaagattctaggtaccacgccggagatgatccggccgaacggacagattttaagttatccggttattacggcgggcacatttcggaatgaaagctcctttaagaatctgcttggatcgcaggcggaagaaagtctggaggaggcatgttctctggaactcaatgtatctgaatatacgccaaagacttttatctggcacacctatgaggattcgtctgttccggtacagaattcccttctttatgtcaatgcccttgtaaaggcaggggtaccggtggaattccacctctttccaaagggacaccacggacttgggacggcaaccgatcttagtcgttctaaagatggccggggcgtgcaggtacagtgcggacagtggatggatcttgtgaaagcatggattgatcacaacattccggatgacgaggcatagggaaaggagcggatcaaggatccggccagtttacatgaccgaatagtttcaaaaaatagaaatcatccaggcagggggttgacaggaaagctcctcctgcatataataatagaacaactgtctgccaaaccagggcttgtactggtttcgacgggggttttgaagttggagaagccatccgcgggacgggaccgcgcagtaaaccgtaacttaaaaataaacgcagacaataataaattagcgtacgctgcctaatttcggcagcagtcggctccggactgcccgcggtctggattaccggcttcaacacttgcggggcacttcgtttccaaagctttgaggagatggaagactttatgaagctaccgaagatggcagcctgtcattaggcggcaatccgggggaatctcaaaataatgactgtgatgggagatgctctgatggagaggctttcggacgcgggttcgattcccgccaggtccatacgaaaagcgccgtgtttacggcgcttttttcgagtttgcgttgcattttgagccgcgtctctgtttggatgcaaaaagataccttgttaagttttcatatcttgggaaagaaaaggggtccagccttttccggcctgcgaagctatgttacacgaaaggggcataaaacgagagcgtgcgtgaccagatatggtaaaatagtgttcgattcaattttttaacaaatgaggagtgaaaacaatggagtgttgtaattttgcggtcattgatacagagaccaactggaacgatgaagtgatgtcaatcggaatcgtggcggcagacgcaagaagtaaggaaaaaatcgattcgctctactatatcatttcaccagaatatcaggtgggagggatatattcggcagagcttggattttgtgaacatggaatcagtgtggcaagcagaaagcaggcattaaaggagatcaggcaatggctggacgcatataaaatagagaaattgtttgcgtacaatgcttcctttgacaagcgccatttgtgggaatatgcaatgtttgaatggtatgatattatgcgtctggcggcgtaccgtcagtataatcgggcgatcccggcctgtgcggactgctgtaagacgggcaaactgaaacgtggatatggtgtggaggagatttttaaaatgctcacaggagatgatcggtatagcgagacgcataatgcggttcgggatgctgaggatgaattgagaatcatccagttgcttgggcatggcctgcaacagtatgagatagcacgtatctaatggacaaaaaaatatactaaggtcagtaggccaataccaaagcacagggcagtttcagatgaataatctggtggtaaatcatatggaaaacaggtataatacaatactgagatatgagagtgatcgaggtggattatgtaccatattgcaatctgtgatgatgaaatagaatttgtttctgaactaaaagatctgttgaaacgatattccggggaaacagggatagaacttatgatagctgagtatcggaatgggcaggagctgatcgagaattatgatacaactaccgatctgattttccttgatattcagatgaataagatggacgggctgacggctgcaggaaaaatacgggaactggatgaagaagtcagcattattttcttaacatccttaaagcagtatgctctggaaggatatcaatatcaggctgtgaactatattgtaaagccgatgaaatatatccgcctgaaaacagagatgaatagctggattgaaagacacagacacaaaaatccctatattgtcgtgcagaacgatagaggttcttttaaagtggctgtgagtaaactacattatgtggaaacatacaagagaaatctactgttacataccgatgatggagatgtgatatgctataaaaacatgaaggagatggaaaaagaactatccctgtatggttttttccgctgccacgttgggtttcttgtgaatctttcttttgttaagaacgtagagaaattggatgtggaattgacttccggagagacagtctatgtcagcaagccaaaacggaaaaagtttatggaggtgttagccggatattgggggaaaatgctgtgaatacggatattgtaacaattttcatcgatataatatgcacagtatgggaaggaatgattggggcatatctgtttaggacttatgcaacgaaactaattccttggaaaaaagatgttctatgggtatgcttttttgtcctgcttgcggaaacactgactttttctcctatctcttccattataaaaatagtggttgaactatttttatgtgcatttattatatgccggttatataaaatcagtatgccaaaaggacttttatccatgctgttttttatattcagcggcgtttttacagaaatgatattaactactgggttaggatttttattttctgatcttacaaattctgatattgcttggcaggcagaatattatttgatctatcatattctcatgttattgattgccgttgttataaagaaaacattagtgaagattggaaaaaactttacaaaacgagaagatctattgtttagtattcttttagcggcactgatcttcatatttatgagttctgtaaatagtttactctatggacgggatataattacccaaatatcacagactgtaggcattattattctacttgctgcattgtttctgctgatttatttcgtatatgatagtgcaagaattcgtctgatccagcaaatagaagaacagcagttacagaaattgcaggctcaatatcaatattatgaagagcggttaaaggacgagcaacgtgtccgggagatttaccatgatatgaagaatcatttgcttgtattgcaggcgcagttgaaagagattggtcatactggagataaggaaaaaaagcaggaaacggaagagatgatcgcaaagcttcagaatcagatttccgattatgaggattatgtgcagaccgggaacactattttggatgtgatcctgcgggataagtatagaaaggcgaaagagaaaatcatagacttccacacagagatagatttctcaaaaggagatttcatagatgccctggatattagtaccatattcggaaatgctctggataatgcaattgaggcgtgtgaaaaagtgtcagaagaagagcgttttattacgatgaaggcgagagaaaaaaatcattttcttgtcatacacatagaaaattctgcgatactggaggaagaggagaaaaaaaccacgaaagaagatacgtttcttcatggttttgggttgaaaaatatccaaagagcggcagaaaaatacggaggacaatataaacgaaattatcagaatggagtgtatatgctgtccattctgataccaatagcagaaaaataggatttggatatttgatagagagctgtatgttgcatgaagagtggcatacagctttttttgtgcgatatgagcgaggtatcgcggtgagctgggaggcgaaaggatgaaaggatcttcccctccactcgattgccgactgaggtcaaattacgcattgtggaagtcaaagaacgcaactgccattgaaaaaattcttctgaaaaatatactgaaagcaagcgaaaagatgacgctgtattttcatttcacaggaggaattgacgatatgagtattctgaaagtaaagcagctcaaaaagtattatggcagcgaggaaaatctcacgaaagcactggacggtttggatttgtctattgaaaaaggagagtttgtagcaatcgttggagcgtccggcagcggaaaatccacgcttctcaatatgatcggtggtctggatgttcccacttccggaaaagttgtgattgggaataaggaaattgagaaaatgaaaccggacgaactgaccgtattccgcagaaagaatatcgggtttatttttcagaactataatctgattccggttctgaatgttctggagaatatcactctccccattgaactggacggaaaagcgtcggacaaaaagtttgtaaaagagattattgaaatgcttgggctgaaggagaaggtctataaaatgccatcacagctttccggcggacaacaacagagagtggcggttgcgagagccttggccagtaaaccggagattattctcgcggatgaaccgacaggaaatcttgactctgagacaagcgaggaagttctggagctccttcagaaaaccagtagacactataatcagacgattgtcatgattacgcatgatccgcatatcgcggctagagcagaccggatgatcaaaatcggtgacggaaagatcattgcgtaacaggaggggagaatatgcgggcagatagaaaaatacagaatcgggcaatccaaagattcgtaaagaataataccagaaaaaataaggagcgaaatgtaattcttgttatagcagttgttcttgtcacgatccttatgactgttatgtttggcgccgggatcagcatatttcataactttcagcttgcaaatctccgcaatgcgggaacaaaggcgaacggcggtctttacatggcaacagagaaagaaatggagcagatttccgctttggatgaagtagaggcgacgggaaaacagcagtttgtgggagaagtactggatgtgaaggatatgcccagtcagacaattatttcaatgactgcgtatgataagacggagtgggagaattttatcaaaccgactgtctctgatataaccgggaattatccgcggcaggaaagtgaggttatgctttcacgttggacgctggaaaaattgggagtagatgatccgcagattggtatgaccatttccgtaaaatataaacttctttccggggaagaaaaacagcaggaatttactttgagtggctattatacggattttatttatgaaaccggagttacgccgaacagcggcaacactatggctgcaaatctgtatttcatcaaccgttctatgagtaagcgtgcagccgggaatatgatcgtttccagccgttttgcagaggagcacggaaaggaagaagggggattgggaacttttctgatcgacgacagattaaatgcagaagaagcacttgccttgctggatcatgccgccggaaatgatgaaatttttgtatccgggctgtcaggaacagcggcacaggcgcttatgggggctatgattcccattttagcagttatttttgttatgattagcggctatctgttaatttataatatcatcaatatttctgtactgcaggaaatgcatatgtacggccagctaaaggcgttaggcgcaacatcaaagcagttaaagaaaattgtcaggaaacaggtaaatctggttgcggctgtggggattattctgggattgctttttggaaccgcatttgcggtcatcacagtacctaaatttctggaagcgctcatggacagccagaatgggaaatttaaattcggaattacggtttctccgctgatctatgtgtttaccgttttgtttgcatatgtgacagtctggttcagcgcaagaaaagggacgaggctggcagggaaagtgtcgccgacagaggctctgaaatatgtggacgttgtacataagataaaaggccataagggcagcggcggaggcaaattgtaccggatggcttacagaaatgtatttcgcagcagaaaacgtgcgctggtcgcatttgcttctctgtttttcggacttctgatctatttgacggtaagttcatctacgcagaagcttgactataatctgaaatacgaccgtgaaatgccgtatgattttgttatggaagatataagctggcagttggggaatgaagaaaaggcggagaaaagtctggatgatgggatacttgaaaaagttaaaaacctcgaaggagtcgataaaatagagacggattatgtggaagttacgaaagtagaggaagcggaacagtttctggctccttatgcaaagctacaggctctgtatagcggggctgaggaagaagtctggagtgacctgcggtttaaggcagttggattatctatggagaagctccaggaatttacatggaacagtacattgccggacgaagaaatacagaactatcttgagtcgggaacagggatatttctggtggcaacaaaggggagtgcttacagagagttcacgggaaaagagatacaggtaagcaaagttggcgtaagcgttgagagcattacttatactgtcgttggtattctgacaaaggcgccgggggaagaagggaaaacctataaaaaccagtatttaaattatggtactcaaaatggcagtgagatcagtgctttttatacctcggaacaaggagtggaaagaatagacaaaacacctcatatacaaacaatccggatagactgtaaagcgggcacacaaggggacatctcaacggaactgaaagagatggcggcgcagatggacagtgttatgataagttcaaaatccgagataaaagcaggcgttgaccagttagcgggagtaatccgggcggcaggaacggtgttaggcggatttctgatctttatggggctcgccaactttataaatgttatttttacaggcatttactcacgacaaaaagaactggctgcgctggaaagtatcggcatgaccagaaaacagataaagatcacacttgttctcgaaggggtttattactgtggcattacgatggttcttcttatgacagtgggcgagattttatcttatctgatcttcctgcttataaaaaatggcgtgatatattttgcggtttattcttttccggcagtacagatgttgtgtgtgtttgtgattctggtgatcgtatgtgtaaccgtaccccttgtagttcttcgttcggtatcaaaagagagcttggtggaacgtctgagaaaagggcaggactaaggaagaagggggtaatttgatcgtttataagctgaaatttgtaggagacggggagtttatcattatatctccccctatcctgcgccggttgatagaaaaagtaaagaagagttcggaaaaagaactgacggttgagtttgaccacttatttccgaggccgtatcaggaatacctcttaaatgtaattaacagtaactcagatgaaccatatttttcttatgaatatattccaaaggtactattggatcagaacgatttgttcaaaattgcagaacatcaactggaggaaatgaagatagaagatgtaaattgttttgatacagtgagattactgaagaaaagagggaatgttctggagatgaactgtagtaacagtttctggactgcttgtaaaaattcagaggcggtgtttcagtacagcaatccggaacctttttaaaagggatcagatactttttagagaaggaaagtttttctatttatacaaagcctgccgggtcggcaatttaaaatccgagaagaagatgttttaaatggatatgaattaggtgcggacgactatgtaaccaaacctttctccatgaagattttgctgaaaaaagtgtatgtgattttatccagaaatttatatttcaaatgtatatggaatgggggatatatggaagtgatcatctttatcatatttttggtgttagtggttatcattatttttacactttggaaatatgttcgtttgaaacaagatgtttatgaatatacagagaaatagatactgttataggccaaatgttgaaaaatgaagaattaaaaccaagtccttatgaaaaagatgatttgtgggaaaaaatctatggtagactagtacgactttcatatctatggatggcggaaatattcatatcgctgtgtgcagacaggaattttttacaaaaatcagcattgaggacgctggaaaaggtattgtaccagagtggcaaaggatgaatccgaatatgcgcagatcatccggtacgcaaaatatccggataaaagagagcagcttggaggaatggatggacagcaggttctgggggcgctcagtcccttttcccaggaggaatatcagctcgagagggagctgaagaatatcatcaaccgtatcatagagtcaaacagcgaggagacgatcccccggtttgcagattaccgtaattacatgacatatgagattctgataacaaatgacgttttaaacagggcgaaactgtcgcggcagacaggctatagttccggagcggaagtacagatcccgtatcttctgatccttacgtctacgcttcttatgatctactaccagagaacgaattccaccaggcttgtttttatcgatgagccatttgctaagatggatccggggaatgtgaaactgatgctggattttatgaaacagcagaaacttcaggtaatattctgttctccggataagacagagacgattggaaatgaatgtgaagtcattctgccggtactccgtgtcagacaggacagtatgcagcttggcatagtgcagttttatgaaagagaggacggaagatgatagcttttgaggatgggcgtacagcttactatcaggaaaaatgctggcagcgctggcagatgcttacagaaagagcaaaaaggacagcggaacgaaccggatcaacagacggaccggtctaaagccggaaaagctttatccccagtaccggcagaacagtggggagtccgctgagatatccgcctttaatacggcggctgaagaccgccgtaaaatgggatttgtaacaatgctgaaatcaatcagcgaaattgctccttatgttccgtttggcaaatcaaaggagtgaccgatttgtgcctatcaatcatgttaggaagatagtactgcttttacgaataaaaaaggctgaaagcaaaaattcttgctcacagccatttgaaatttcatacgggtgtctcttgcgatgtgcttaacttattggcattgatttcccgattgttcctttttgatgctaatgtattaactatcaatttttttaaggaccttattgatttttgtggctttagtttttgaataccaaagtgcggtggagtgttgtcgaagtagtgcttcgagatataggatgtctatttcatctaattttttagattcatcggaactatcatcgaaattatcaagaaacttctcgttgatataagcacaatttcgtacggtcaaatatcttttggttctgggaaggctgtcaatagtcggatatttctcaaggaagacatcaagggcaggtgaatcatattctttttgcttttcttttaattggctgtaaccataatcgtctatcgaaataaccgcttcgttcatcattaaatttgaaatcattactttataagctttcgaatcaaatttgattggtttacggctaagaatcatacgtaatgaacaaggtcgatgcctttcttcatcttgatgatgagataaggttaaaactgaagccgtaaggtattgcagtcgcttctctgtagaaggtttggacattatcatatacatgatatcaccatcgctctgcctcgttaaagaacagaagatggaagtgttatcgactggagaagaagcactaccatcatagcatagtattttatgctcggaaggatttgtcatgtattttagcactgcgtagtatctgccacctttaaattcaatatttagtgtaccacaataaatatggtctggtgaataaagagaaaatagctcagccaattctgaactttccggtacatggcttggattcttttttaggattttttttcgctgttcttttattttagagtcactgcttggaaaataaaaataccatttccctctgattggttctaggatagaattttcagagactagggtgctgacagagtccttcgtattagctgtttttgacatcttttttccactgttgatatcatagaaggctgatggataaagaatttcatcaaaattccccctgagtagatttgtcaacttttcaaaatcattgcgttgcaaatttttttcaacagcttctttatgttcgtacaaaaatagaattgacgaaagaggaatattaattatctcacaaatgcgattaatatgttcagatgtgatctgacgtttgtctttggcaataccatgacgtaacatttttgaaaatgtggctgagtcaatacccatttgcttagcaatatcccccattgtcattttatgagttcttcttgtataaagtttcacaaaccaatgcaaagggacaagatatgagttatatcttgcatctttattcacttcgtccagttggtaagagaaaatttgtgtgaacgattgtttctgcatatcttttttgcttttgttattcatagcgaatcatctccatcctaattatagttatagtatatcaaattctgtcaaaaacacaatgaaaacaaatgttattttgtcaaaaacataattttcaaagcagttcatgattttgactagttattgttaaaaatggttaaaagtggtaggatattggtatcgaaaataatatgaattgtataatgtaagtgctcgaaaggaggggaactgacatgagtaactaatgtgcgtaacagtaaatgatattatactgatttgacgaaaggagaaaacaatggaaggaaagaacgaaattatgaacatcatggattatgaagttgttgataccagatctaatgacattcagatttctggtactgaggttgctactcagcttgttgctgtagttcctaacgcaattgcagcaccatttcagagatatcatgaagtggaggtaaaaaaagagatagcgctcaaaacactggagtatcgcacaaaagcgctagagcatcgtacaatggatcgtgacaaactttgtgatacaatggttgagcttgctaagaataagtcacttgataaagagacgttccagatgcttatggtcgcatacgaaaacccaattttttaagtggaggtagccatatgaaatttggattgacaactggacagagcgtaaagagggctgaatccaatctggcatcatatcagaaggttttgaaacaacacgagaacaaaaaagtgtttgagactatgatgtctcttgcacagtttggtgaattgacaccagaaagatatgccttctttatgtccgtaatatcaaatcaagaaaaaggagagaacaaggttgaagaatacatccttaatcgatccttcaagatgcgggatcgtaaagaataatcaaggagcgtatgtttcaaagaatgaggcatatgcgttagcgcagacagttaaagatatgtttgttgctaatggaattgagtacgaagtgcagcaggctgtatgtaaggaaagatcaccagaggcttacgtaaaggctggaccgactggtattaagtttaaattggggttcacatggaagactactacggttaccaagcttactccgagaggaggaatctttgatgattagtagcgaaaggtattctgttggaagtgaggatggtaaaagcatctctttccagaaggaagaaggcgcttttgtaggttttgacgttacaataaagtttaagcacgtgatcgcagtaattatttgtgctgtactaatcataggggggacaagctattatagtagcgtacattcggagcagaacggagctgaggtacaggatacagttcctcggaatgaagtgcagccccccatcgatgaagatggttttgtatttgctaaaagtagcagtgaagtgctttctgaagaaatggtgttggctctgagagaagatgagacagtaggttttcagaggcttttaaaaatgtctattaatgaaatttacgcaagacatggccagctattcaatgctggagaagtaaatgacacacattatcagaaatatagttggtacagagaaactaataaacatggcgttaagtgggaggaatttaacaatttcgaaaaaacaaatctgagattattaatctcaattgaagaagagtatggatatagataaaatagaacagtatgggtgagaggaagctattgcggtgtggatggcttcttctttttttgagtgtactatgtagagacaatgataaaaattatagggacagagagatttatggggaaagggaagacctcacgtatgcgattattaatgattgtctaattgaaagacactccagttcattatgcaggaaaacgtaacaaaagaaaacccctaacccctcatgattgggggggggggggtaaggggagttgaataggagaagcctatttttaaaaaaattatgatatgtagtgagatttttgcaagtttagtatattaaaattaatataggaagtgattttcacatatgaataataaatagttctgtagagaaaaccgtaattaattgttgatataaacaaaagggaaaagtgtattgagacagttatatgaatttcattttataattattaaaaatgcataaaattcaaagataaatacaactgtttatgaggaataaataagatatttcttttggaaagaatatagaataggattgatttaaaagtataaaggtgatatatttaaatattagtaggttagttaaaactaacaacaataccatattaagtaaaagagaatgggagaaaatcatgaaaggaaagaatttagaacagtatagcaacgtaactgggtttgaaaaaattgcttttggagaactcatcgatagatggggagaagtatatggcaatagaatcgctattaaagacaatagtagagagattacctattatgaattaatgaagaacagccggaaactagtaaaaaagctcagagaatcaggtgttaaggaaaatagtatagttgttatgcaatgtactaataaaatctattttgtagagatattatttgcgctattccgtatgggaacagttcctgttatggtattgccagcctatagagaacaagaaatagttaaaattattaaaaaaacacaggcagatgcctatattgctccaatagaatatgctggatataaatatgaaaatataaggcaagaaattaaacgtaaatttcctgatatggttacattaatgattgacgaacattttactaaccaggaggaaatgataggagatgaatgtgttactaccagagttaaatatgatgatgtagcaattttattgttatcaggaggcactacaggggaacctaaattaattcctagaacacatgcagattacatctataacgcaaaaatggcagcaataagaagttgcttaggggaagagtcagtttatctggcatcgctatctatagcacataatatgccattggcatgccccggaatactgggaaccttatatgccgggggaactgcagtattaagttattattcaagtccggatgagattatggagttaatagaaggagagcgcgtaactataacgggcttagtccctacccttgcacagttatgtatggaattactagaaatagaagattttgatatttcgtccttgaaagtaatcattactggaggggctaggttagagcctaaattggcggaagatataatgcgtaattttcaatgtattctccaaaatcagtttggaacagcagaagggttagttatgtctacttccttgggggatccagatgaatggataataaaaacacaaggaaagcctatatcaaaagcagataaaattaagattattgacgaaaatggtcaagaagttgcgaaaggggaaagcggtgaattaattgtaagaggcgtgtatacaattgaaagttattataatgagccaaaagctgatataaaatttactgaagacggatattataaaaccggggatagagctttaatcacagaagaaggtaacatatgcgttttaggacgtatacaagaacagatcaatagagcaggagaaaaaatccagccttcagagatagaagagggattgcttgagttggaagaaattcaacaagtggtggttgttgctattgcggaccatctgctagggcaaaaaagttgtgcgtttgtacaatttaaagaaggaaaaaagctagataagaatgaaatttgtaataaacttcagcagaaaggaattgttcactataaaattccggatcaaatagagtttatagaagaatggccaaaaacaaaaataggtaagatagatataaataggttgagagaaaaagtaactattaaataagctatgaaggagagtgtttatggagaacatagatataaatactaggattattatgtcgatgagtcaaggattcgcaaatacatacttattatatactgcttgcagattggagatatttgattttatagaatcaaatatagatacatctgtagaacttagtaagaaaataaatatagaaaatgttatcttggaaaaaatattaagaccattagttgcgtatgattttttagaggaacaaaatactaaatataaattgactgaaaaaggtatgttactgactgataaatctccaagatcgctgaagggatatgtcttatattgcggaggaatatgcgctaaaagttgggcgatgatggcagaagcggctaaagatagaaaaacgccatattcattagctataggaacagaactgtttgcagaaaataggaaagacgagaaacagtacaatacctttaataatatgatgaattttgtgagtgaaggtgtgttgttagccgactttttgaacgatatagaagatattaaaggaaaaaggattgttgacattggaggaggaacgggagcaatcatgacacaatttcttaaacattttcgttctgcctctggaactataatggatctggagtttgtaaaagaaaaagcattacaaaaattaaaagagaattcattattggaaagatgtgaatttgtatcaggagatttttttaaaccgttttctatttctggagatatatttgtattatcaagagtattgcatgattggaatgatgaagattctataaaaatattgagtaatattagatctaatatgactaatgatagtattctatacattatagagttaattattccagaaagtataacaagagaaaatgttgaagtgtatatgaacgatttgcaaatttgggctgtatgtggagggactgaaagaacattatcagaatattgtaatttgttccaaaaagcaggattaaaatttgaaatgtgtagaaaaattcgttcgggagaaactatattagaggtacggttagatacaaaaatggaagagggagaaatataataagaggtgattgcgatgaataaatttctaaaaaacgaagaaaaaatcaggacaggagataaaatattattttgctttccttttgcaggtggaggtgcggctgcatttaatggctgggtaaagttttggaatgatgatatgatagtttgcccgatccaattgccagggagagaagagagaattatagagaagccatatacagatatgggaattctaatagaggatttgtataagtgtatctctcaatatagaaatcataagctatatttttttggacatagtatgggggcaaaaattgcgtatggggtagcaaggaaactagaaagtaacgggaaaattctagaacatctaattatatccggaagcagagtcccgcatttacctgaaccaaatccaatttatcatttgaatgatgaagaatttgagaaaggtattgcaaggtttgatggaactccgcgtgaaatattagagaataaggaattaatgagttttttcttacccatgttgcgggctgattttattatggatgagacatattgtgttcgggatataaaaaagttgaatagccctataactgcgttaggtggaactaacgataaagaagctgataagcaaacgatattgaaatgggaagattatgcagaaaataaatttagtgcattcttttttgatggcggacatttctttattagagataaggagcaggaagtattgaataagatagagctaatatttatgaataaagatgaataaagaaatatttaataattcggatttaagaacaattagagaattgcagaaaaatgaaatacatatttggtgtatacaatggtgtgaaatagcagcgaaggtacaatgtaagaggtgtttactagaaaaaagtgagattgtaaaagctgataaatttataaatgatgctgacaaatatagatatttagtaggaaggattttgactaaatatttagctgcattttatcttagtgttcaaatggaaaacataatcattaaagaggataactttgggaaaccataccttaaatgtaaaactaaagagattaatttacagtataatttgtcgcattcaggagcttacctattattggtatttggctatggaatgtctttaggagttgatgtgcaggaaaaaatacaattggctgattataaagatattgccgagcatttttttcataagtatgagtaccaagctatttgcgaggatccaacagagaatactttttttgatatatggacagctaaggaagcatatgtaaaagcaattgggaaaggctggtcacaagattcagatagcttttatataaaaaataataacatttattccttgaatgaaaagttaggaaactggagaatatatagattcaaattagatcgtaactacagtgtagcgatagtgatgggagaacatctacaaaaaggagattagttttatggaatacatacagcttaaagaacaagtaaaacaagagttacccgttaatgtagaaattgaagaagaagataatttattagaacttggattagactcgctaaaaattatgcgtttggttaatacttggagaaaacagggaattagaattccttatggtcatctcatggaacaacctacattaaaacattggtggcagttgattcaaaaaagaatgaagaaaaagagaagtgataatattctttataataataaaaataatgttgaaataaacaatgttgcctttccattaactgatgtgcagtatgcgtataaaatcggtagagaaaaaggtcaagaattaggggatattgggtgccatgcttatttagagttttcaggagaaaatgttgatagtaacaaattagaacaggcatggaatctcttacaataccaccatccaatgctgagggctagatttttagatagtgggttgcaagagattatggaaaaaccatattgtgaaaacatcgaagtaatagatttgagcgaaaatccgaagtttcaagagattcttgaacagaagcgattagaattatcgcatagaaaattaaaggtagaggaagggcaagtggcagcgcttacatgctgtattttgccagaaagaaagacaaggatcctattcgaattagatttgttggttgcggatgttcaaagcatgcagattatacttagggatttggcgacggcttatataggaagagagttgccagaagagtctaaaaattggaattttggtgtgtacttggaaaatcagtataaagatgaagctgaggaaagaaaattagctaaagaatattggaataagagagtacaagatatgccattaggtccagaacttccattagctaaaaaaccatcgaatcttacagaaatgaaatttaataggagaattgttagattacaaaaagaggaatgggaggtattacagagaaaagcagcagaaaatcaaattacccccgcaattttgctattatctgcatacgcatatgtattagaacgatggagcagcaataaaaaattcgtgatcaatattccgttttttaataggaaaacagagtacccaggcattgaggaagtagtggcagatttcacgacgttacttctcttggaaatagatctggaaaaaaagaaaacctttaaagaagtagtagaaatgataaaaaagcagctctatcaggatatgaaatatacatcttattcaggtgttcaggttcaacgtgatattgctcagttatcaggagaaagacaaaccatagcacctgtagtttttgcatgcaatttaggaactccattagttaacaacgaatttaaggataacttaggtaaattttcttatatgatttcccaaacacctggaatatggctggattttcagacttatgaagatgaagagggaataatgctttcgtgggacagtgttgatgagcttttctataatggaatgatggatgatatgatgggaagtttcggagacttgttacatcgattaagaactgaaaactgggatgcttattacgatgttttacctaaaaagtatcaaaaatttgttgagcaacaaaaaaacataaagaatattttgaaaccatcttgtctccatacaaaattttttgaaatggcgaaagaaaatccggataaaattgcaattgtggataccggaattaataagaaaatatcatatggagaattagctgaaaaagcggtatctatagcaagttttttggcgaaaaacaatattcaacgtcaacctattgcgatttctacagctagaggttggcatcaggctgtagctgcattagggattcttgcatcaaataatatttatgttccggttactataaaccaaccggaagaaagaagaaaaataatacatgaaaagacgggaatccggtatgtaataactgatcttcaaaattataacaagatcgtttggcctcaaatggcaacaatatggacagtagaagggatgatgtcagaaaacagaacagaaatattgccggaggttttaccagaaagttctgcatatatcattatgacttccggaactactggcattcctaaaggtgcggaaatatcccataagggtgcgtggaatacgatagaagatgtaaataaacgtgctatgattggcagcgagaatgtgttcttaggagtttcagcattggactttgatttatcagtatatgatatatttggaactttaggaattggtgggaccctgataatgatttctgacgagaacagcagaaatgcagaatattggttaaaaatggtagaggaatatcaagttactatttggaattctgtacctattttactaaatatgttattaatatgtacagaagcacaagataaaaaattaccatttaaagcagtattggtttcaggagactggataggaatggatttgccagaaagaataagtctatgtactgataagtgtaagtttattgctatgggtggcgccacggaagcgagtatatggtcaaattatttagaagttaagctgcctattccggagaactggaagtctattccttatggaagaccgctttctcatcagtcgtatagggttgtagatgaaaaagggctggatgttccattttgggttccaggagaactttggataggtggagaaggcgttgggacatatagaggagatgggaagttagtaaaagaaaaatttgtaagagatgcaggcaacatatggtataaaacaggagataaaggtcgattttgggatgagggaacaattgagtttctaggaagaaaggattttcaagtaaaaattcgtggtcatagaattgaattgggggaaattgaagccgcattaagaacgatagttggtattaaaaatgctgtagtggaaccaataaactctgtaggtggagagcaacatctggttgcttatttagaaacagtgccagaaataaaagaacccttatttcgaaaaaaggagacagaagaaattgttgaagaacaatgcaatagattaaaagggcttaaaataggaatgtatgacgagagcatgtattataacttggttgaatatgcggaggaaagatcccttgaaattatgctagatacattacaaaaaataggtattttaaactctggtacaactattacatatgattcaattatgcaggatagtagagttgatacaacacaaaagagtacggttaaactttggataaaggatttattatcgtctggctttataaaagaaagcaacaatggatttgctatgaatattgataagaaagtagtaaattgtaatagtgacttatacagtgaaaaagtaaatcattatatggataaagtgcaaagacaactttatgacataatcgaaggaaacaaatcggcagaagaagttttttatgcagagaatcaaaatttatctcctaatgatttactttcgacattgccgggaaaaacagaaactctgagaattttgacaaagttaatgcgagaacttatagagaaaaaagagggcaaaattagcatacttgaagtcggaacacgggatacagaaaccacagagtttcttttggaatcggtaaaggagctgggagttgaatatacctatattgattcatcagcatactttgttaatagtatgaaaacatttaaaagtagatatccgttttttaaggcgaaagttattaatatagattccgacaatgtagatgtacgagaattggatagatgcgattgcgttatatcagtaaattatctacataaagtaaaatcagtaaaggatgttttagcgaacattaagcgaatattaaaagatacaggctgtttagtggccttggaagttaccgaaccgactgtaatgcaggatatggttgttgcagttcttgaaggtgaaaactatagaaaagatataataagtagtgcttcaaagtgggaagcagagttccgaaacaatggatataaaaatattcaaatatatccagaacataaaagtgtatttggaaggaatatctttgctttaatgtgcgaggaggctgggtacgaattagatgaacaatttattagggggaaaatagcaaataaacttcctgaatatatgatacctaaaacttatcataaagtagtgaatatggctttgaataaaaatggaaaagttgataggaaaaaattgaatcatttatatatcggtgcatcagaagaacagagcgtaattttgccaacaactgcaacagaaaaagaactttgcaaaatatgggaagaaatattttgcaaaaagagtattggtattaccgaaaactactattctttaggcggagactcgttgcttgcaaccagaatgcttacgaaaataaaggcgagatttttggtgaaattttctatagcggatattatgggaagaaaaacaattagagagcaagccgaacgtatcgatgaactaagaaaaaatgatttagtcgaattggagggtaatagttatgagttgaaagttgataaggtacatgaatttgaaccttttcctttgacagatgttcaacaagcatattggattggaagaagcggcacttatgatttaggaaaggtttcaacgcattgttattttgaattagaggctcttgatctgaatattcagcaattacaacaaacatggaacgatatgataagatatcatggaatgatgagagcaattgtattacagacaggggaacaacaaatactgcgagatgtaccagaatataaattcaaaatattggatttaagcaatgatttagatgaaaatatatcagctaacctggaaaagatacgcgaagaaatgtcacatcaggtaattgcagcggataaatggccattatttgatgtaaggattactatattaaaaaataaaaacattcgattacatattagttttgacaatcttatttttgatgggtggagtatgttccatttactcagtgagtggacaaaaagatatagaaatgaaattcaaactttcccagaattgaaaatctcttttagggattatgttttggggattgagtcactgaaaaaatcagaaacatatgaaagagatagaaagtattggttggatagaattccagaattttctttggcgccagagttaccattagctaaaaaagaaggtgatataacagtacagaaattcaacagaagatcagggtatttaagtgcagaagagtggaagagcctaaaagattctgcacaaaggtatgattttactccggcagctcttttgctaactgcatatggtgagacactacgccgatggagtttaaataaagagttcactttaaaccttactcagtttaacagagtgcccatgcatccgcaagtaaatgaattagtgggagattttacaacgttaacacttttagaaatgaaaaacgacagcaaggctacttttttagaaagggcaaaaacgattcagaatcagttgatgcgagatttagaacatattcagtacagtgctgtagaatttcagcgtgaattaaagcgtgcaaagggaatttctaatagttcatttatgccgattgtttttacaagtggtttaggaattagtaaatggagtaatggagaatggattggaactccggtatacaatgtaagccagacaccgcaggtctggttggatcatcaagtagtagaaattaatggcggattgaatttgttctgggatagtgtagatgaactatttttcccaggtatgcttgatgagatgtttaatgcatacatggatttgttaaaacggttagcgaaaagaaaagaattattcgaagaaaaaagtgcttctttaattcaagtgaaaatatctgaagcacgtaaattggcgaatgaaacattgcaaaaatttccaacgcaaactctaaacgatatgtttctaaagcaagcagacaaagaaccatatagagaggctgttgttagtgcggaaaggaggatgacatatagagaagtaaagttagaagccctttatattgcaaggcttttaaaagaagatggtgttaaaaaaggtgatattgtagctattattatggaaaaaggttgggaacagataatagcggtatatggaacgctttttgctggagctacatatcttccgatagacatacataatcctaaagaacgtatagaaaaaattttaaatgatagtggagcaaaaaaatatcttatacaaccaaaagtgctgaatgtacatgagtggttagatagaaaagagtgtgtggtagtctcaggagaaaaagatgagaatgagtttcaacctgttcagaatactctagaggatatagcttatgtaatctatacatctggtagtacaggaatgccaaaaggggttatgattacccataaaggggctgtaaatactattatagatattaattctagatgttgcataagtgaaaaggatgctgtcttggcactatcaagtctgcattttgatttatctgtttatgatatatttggaattttaggaagtggtggaaaagttgttattccagaatattcacaaataaaagatccagaaaagtggcttaaactaatggtggaagaggagatttctgtatggaatacagttccggcatttatggaaatgctagtatcatatatgtatggcaaaaatattccaggtacagaaaaattaagaatagttttactaagtggagattggattccggtgactttacctaaaaagatatatacgctgtttaaagataccaaggtgtttggtttaggtggagcaacagaagctagtatttggagtaacatattcaatattcctaaagaaatacctaaatcctgggttagtattccttacgggaagccattatcaaaccaaaaatattatgttttggataaccatatgaatgattgtccagattgggtaccaggaaatctttacattgcaggtgatggtgtagcaaaaggatatattaatagtaaagaattaacagatagaagttttattacaagggaatctaataaggaaaccatttattacacaggcgatgtggccagatactggtcagatggaaaccttgaatttataggacgcgttgataatcagataaagattaacggttatagggtagaacttggagaaatagagtgcgctttattagaaaatgattctattacaaatgcgtgtgcgatggttgtaagaaatactattattgctgttattacagctaaaaacaatatactacaagaagatgtattagcagtaataaaagataaactaccagaatatttcatgccaaaggctataaaagtatgggagagtatacctttaactgtaaatggaaaagtcgaccgcaaaaaaatagctgaggtcttggaaaaatcggaactctttgaagaaaagcgggatgaacctgtagttggagctatggaaaaggctattgcagaagtgtggaaggaggttctgggattaaaaacactgtctcgaaatgatgatttttttgaaaaaggaggagacagtttaaaggctatggcggtagttaatgaattaaataataagcaattatcagatacaaagatatctcttgtgctattattctctaattctacaccaaagatgttagcggcggcgttagagaaaagtaaaatacaaagtgaaaatacagatatggaggaaggaactatatgatggataaagatttgaatcaaagatatgaaatgttggctattcatcgatagattaaaaaaggatagattttaaagtgggctattatacagaaatgcaactgacatagtgtgtaacgtatcttgttttgataagaagaataaaataagtaagaatagatcaaagcagaaaatgggttatattagttgcatagtcggaaaatatgatgaggtaatattaaatgaacgtaaatgaaattataaacaaatgtgctgagaaaaacatacaattatgggtaaaagacggaaaattacattttaaaagtccgcaaggtgcatttggagatgaactaaaacaagaagtaaaagctaataaagaaaaaataatagaacttttaacccataaggaagtcaatatagtacaaaataatatagaagaagagtatatagaatttccagtcacggatattcaggcttcttatttattaggaagaaatccaggttatctttatgggggactgggatgcaaaatatatgctgaatttctgacggaatttactgatgaaaataagttcagatttgcagtaaaaaagcttgttgaacggcaaggaatgttaagagcacgtttttcaaaagagggaaaacaagctatcttaccagagatatcaaaattaccaattgaaatctatcatttggaaaatgagactgaaaacgatataaatagagaaatattacaaaagagaaatcaaatacaatttaaacaatacaatccagaaaaagatatcatgtttgatttggtcttgttcataataaatcgtaaaaaaagtgttttgtgtttatcattagatatgctaattggagattacattagtatagatgtacttatgaatgatttggaacagatatatagtaaccaacagattgtaccactaacgattaactacagagattatataacgtatacacaacatcaaagggaggatattaatttccttaataagttttatgaagataaagcatattggaaaaataaaattgatcttctgccgggtaaaccggaaatatatacatctgttgattttactgatacagaatcaaaaacattttttcaaaagaaatatactttgaatatcagcaaatgggaaaagttcgaagaaaaatgccggaaatatcatattacaccaactgcgatgatgttattgctatactgtttaactttaaaacaatggtcaaaaaataaagattttttgattaatattacggttatgcaacgacctaatattcatgatgatatacaaaaaataattggagattttacatcgacaacattatttgaatttaaagaaagtgattcgaacagtataaaggaacaggcaactcagactcaaaaaatattatttgataatttgacacataatgcatttagcggaattgaggttttacgtgaattaaaacgaaaagataaggaaagtattattccgtatgtttttacaagtacagtaggctcaggaaataaggagaatatattacaaaaaagacagctattgtataaaatcagtgaaacgccacaagttcttatagattgccaggttagcaagacaatagatggggtattagtgaattgggatgttagagaaggggtattcccaagaggactaattgatgaaatgtttgaaagtttcacggaatatattcataattctgtatttgatgaattttgggaaaataaattgatgattaatttaggaagcaatactcggaagatacgaaaaaagataaatgatacagaaaagctttatgaaaataaaaatttgattgaaagcttctttatgagatgcagaaaaaatccagatagaactgtacttatatgtggagaggaaaaattttcatattccaaattagaaaatatagcagcaacaattcaaacgcgtttgttagaaaatggaataaaaaaaggagataaagttggagtattacttgaaaagggaggctggcaaattgcatcagtcattgctatattatctcttggtgcggtatatgtgccgatagatgcatcgcaacctaaagaaagaatataccaaattgttgatcaagcaaatataaaattgaatatatatcagaaagaagaggaaagaattacggaaaaggatattagaatagatcttcatgatatctctagcaaaaatgggctaaaatatgaatgctttgattcagatgtgtccgcatattgtatatttacatctggtagtacagggattcctaaaggtgtagaaatgactcacgcagcggcaatgaacacaataatggatatttgtagcaaatttgaggtttcggatgatgataaaatattaggaatttccaatttgtattttgatttatcagtatttgatatatttgcggcattttatgcaaatgcaacacttattttaccattagaaagtagaaaaaaagatgtttcccattggtatgaattatgcacaaaatatcatataacagtatataatatggtaccagcccaaatggagatgtttatggcttatttacaggtaaatgattgtagaaaaaacgtgcctcgcttaatactgttatctggagattggatacctgctaacttaatcaagaatattcgcacaagatttcctaagactcaatgtgtcgggctaggaggtgctacagaagctggtatttggtcaatatattttccaactgataaaatgagtgaaacagatagaaatgtaccgtatggaattccattatcaaatcaacgattttatattttagatgaaaatgacaatccttgtgcggattatgttatcggggaaatttgtattgcgggaaagagcttagccaaaggttatatgaatgatcctgaacttacaaataataaatttcaatatataggtcaaatcaatgaacgcatatatagaacgggggatttaggactatacagagaagatggaattatagagtttgttggacgaaaagatacccaggttaaagttaacgggtatagagtagagttaggagagatagagaatgccttaaggaagtataaaaaaatagaaaatgcagttgtagtgagaaataataatggagaattgatagcgtatgtttctaaaaataatggaactattaccgctgcggatactattgcagagaagaaaaagatttgtgaagcagaatttggttttacgtttacaaaagaggattttcataaatggattgaggctgcagataatacggcgctaatgtatattttggctttaatgagaaaggaaggtatgtttaactgtagtgaagagaaatattctcctgaggacattgtaaaactgttaaaagtaaaaccgcaatatcaccaattaattattagatggttgacagctttgaaagataaaaaatttatttgcgaagagaaaggtatgttttatgctaaaactaaatatgctgatgatattgcagaaaaagctgaagaggactggaaactaatagatagaaaaattggatatagtgatgtccttatgaattacatacactcatcttcaactcaactaaaggatttgttgactggaaagaaacatccgaatgaactattgtttccacagggaaagttggacattgcatacgccgcatataaagacaatatagttaatcgttctattaataaggtacttcatgaggaaatattagaaatactaaataaaaacaggcaaaatattagaatattggaaattggtgcaggagtggcgggtagtagtctagaattaattgaaaaactacatccatataatgtagagtattattttacagatgtttcaaaatttttctttaatgaagcaaaaaaacttttctcgcaatacaattggattaattataagatttatgatattaataaatgcaattgggatcaaggatttgagggcgagaaatttgatattatattatgtggaaacgttttgcataatgcagaagatataaagaagagtttaactaatataaggaagatgcttaaaaacgaaggaaaactatttattattgaggaggtaaaaaagagatatgcattattaacttctatggaatttgagtttgcagaggccgttaaagaatattcagatgggagaaaatcaaaggagagtatttttattaactatgaagaatggaaaaatataataaaagagatggaggggcatattattttatcctatcccgaagaggacgatgttttatatccagcaggtcaagttctaatggaagttcagttttcaagtgaaaatgatctagatataaatgaaatagaaagctatttaaaaacaaaagtacctgaatatatgattccttcaaagataattgaattaaatgaatttcctatgagcagtaatggaaagattgacagaaaaaaattgtctattcgcgaggaaaaatatagaaaggataaggtaaatgaggttgaacctttagacgatttagaaaatcgaattaagaatatatggtgtgaaatcatcgggtgtaaagagataggaagagatgaggacttttactcagtgggaggggattcattgctcgttgcacagacaataagtcaaatgatgcaaaaaataccagaaacaaaaggatggaaatgggatgcccttatgatggccttaatgaaaaatgcgacaattaagggtattgctgaagtactaaggggaaaaatttcagaaataactgaagaaaaatctgaaaatatttcgtcttttattagctttaaagagccagaaaaagattgtgagaaagcaaaaattctttttcatgcagggacaggtactttgagctcttacaaagacttactgccatatttagcaaagagtagtagggagtcagaacttttgggtggttttaactttggaagttttgaagaatatttgaatagagatgtcgatagtcttatcattgacactgctaaaagatatgcagatatattggaaaaaatttcaacgaatcagtacatattaatgggctattgtgttggtggctggattgcctttgaaactgctcgcattttagttgaaagagggaaaaatgttgctaaagtagtcacaataagttcgagtctctgcggacataattatgataatgagctacttcttgaacgagctttcgcattatccattggagcagatatagaaaaagcgggatatataggcagcaatactttattacagcgtgcattagaaaattttaagacacataatggagatcgggctatatcaattgatgaattatgtacgttaagtggagagtatgaagaacttgcagtaggatttaaaaaattaagtgaattatcacaggaggaaagattgcaaaaaatatttgcaaccataaaaaagaatgaaggagatgatgctgaaaatattgatatgtttaaaatactttataaattgtttagacatagttttaaagggattatgcgatatgagccatcaatttatgtaggagatgtgcatgctttgtttgttgcagatgatacaaaacattttttcccggtaagagatattagtaacaaagaactgtgggaaaatatagtactgggagatttgacaattgattatattccaggagaacatacaaactgtcttaaggaacccaatgtgcatgatgtggcaaaaatactagaatagttaaaagcggatggggcagatactgtaattgtatttgccttattcgattttatttgaaattatggagaatataaaatgagtttggggaagaaagataaaaaatactatagaatagtagtgtgcggaacaaattttggaagaatgtatatcaaaggcataaaaattaatgcaaactgcaaactggtcggaattttatcaaaggggagtttgcagtctaaaaaatgtgcaggtgaaaataatatcccattatatactgatatttctcaattaaatagtaaagatgtagatattgtttgtgttgctgtaaaatcctccataactgggggtgatggtgcagaaatagctttagaatgtttaaaaagaggaataaatgtaattcaagagcaaccggttcattataacgaggcaaaagaatgttttaaacaagctttaaagaatcattgccattattatattaacagtttttattctggaatttcggctggaaaacttatgatagaatatgcaaataaattactaaataaaaccagacctattttactggaagctgaatgtagtatacaggtgttatatcctcttttggatatactaggaaaaatgttggggaatgttaccacatataaactaaataaagttaaaacaactaatgaaatattggttattgttgagggggaagtggaaaagataccgttgatattaaaaatagaaaatagaatggcttctgataattccgataattatgcattgttgtttcatagaattgtactttttactagtagcggacaattagtaatggataattcgataggtgccgtattttgggagccgagatattttatagagaagaaaaatgggatattaaattttgaaggaaataatatatattctaatcaaaaagttacagaaattttgaatgaagattgtcttgatgatacttacaaagatatatatgataatgtttggccacagggaatttctaatatgattgacgaatttatgatgttaattgaaaatgaaatggataggaaaaacatacagtatcaattgaatttatgtaaattatggggagaaattggaaaatgtattggacctgtaaataatattttaccagaagaaattataccgattaatggagaggaaattttatattagatatgtttaaatatctaataattaaatgaatggtaggaggaaaatagaatgaagatacaagaaatagaatgtaaaataaagaaaatatggcaagaagaattaaaagtcgatgtaagaacaaaggacaattactttttgttgggaggaaacagtctaaatgcaataaatataatagaaggtattcgaaaagtgtttggaaatataaatattccattttcatatattttttcttatccgactattgaaaagctcagtagaaagatatatgaaatcttagaacaaccaaagtgcgaaaaaacagacttatttgaattgttacaagaagatattaaattagatataacacctaataatgaaaaagtagaaatagaaaaaaatgtttgtttactaactggagcgacaggatatttaggaagttatctattgcgagaattgttacaagagacaacaatgcaaatatattgtttaattagagcagagtccttaagagaagcggaaaaaaagctagaaaattcgttgataaaatttggaacctttgattatgaaaaagggcgtgtacaaatagttctaggggatcttggatgtagaaatctcggaatggaggaaaaagaatatgagaatttggcagaaaaggtagattgtatttaccataatggagctaaagtacattttttatatggatataacgaattgaaaaatattaatgtaaatggcaccaaagagataataaaatttgcaagatataagcgtataaaagcaattttttatatgtcaactatttcgattttttcaaaatttaggtatgataagcgagtagtcttagagaatcaaaaccttagtaatccagggatattaccaattggatatacacaaagtaagtgggtagcagagaggataatttgggaagcaaaggaattgggaattcctgtgattgtatataggttgggtcacattgttggagattcagaaagtggaatgtgtaatactggtgattttatcttcagaataatagagacttgcttattacttcaactatacccaaacgtaaaaggtgaaatagcaccgattgccgttgatgatgtggcaaaaatagtggtagggatatcgcaaaatgaaagggagtatggtaagacatatcatattataaacccacagagcattagttttgaagatgctgctgcaatagctaaaagtattggaatttctttatctccaataaatattagacagtggatagaaaaagtaaaaacgtatgaatgcaaacttcctatttcgccttttatggatttttttgacgagaaatattggaaacaagagaaagagttgatattttcaacggagaaaatgtcagaaattttaaaaaaattaaatcttaatattcatccgatgacacctgaactcatcgctaaatattatacgtcactgaaaaaacagaatcatgtagaggaatattacgaagatggtataattgaataggatgaaagcagataacaattaggcttagaggggaatgagcctaattgttatcatgctaaagattctagatgttaaatgttgggatactctctaattctataattcttttgcaaatctagagttttatgtcgtcgatattctaggggggacatatcaaactgttttttgaaaacagatgcaaacttgctttgattcatgtagccaactttttccgctattgtcgctacagatagttttgtagtggtaagtaaatcagcagcttttttcattcgcatttcccgaagataaatagatatgttttgaccaaaaacgccacgaaaatagttttttaagctggtttcgctgacagaaaactgtgctgccaattcccatgcaggatgatgctgccgcaaatcggaagtaatgattttttcaacacgttttgcaatctctacctgtgtttcagtaaaaaatgtgcaggcctgcgatgggggaatatcgttaagactttgtagcagtgaaaaaagtgccagaacatagaccttcatttgaaagattgaaaatgggggcgcaatatccaaaagtccccaaagttttgtcaatatctcttcgacttcaggagcaaccgttgaaatataggtatttccatttggacaaaaaagttcaataattttatgaaagtcaatgccaaactctttttgtatccatgcactttctgctgtcagagtatcggtatcaacgaagaattccattccctcatagatgcggcgaggatagacatattgcttttgggcgaaacgctctgtgagagaaatttctccatctttcacatatacaaagttttcattattcaagataatctcgcaacgcccggtcacacaatagtttagaagcaacggtcctttttcaatggagctatcttcacagaaattgggtgctgcccatgtcggagaatttacgaagatatacgcaatagtaagcccagggaaaagcgggaaaaaggtcatcgcccccttcccttctttggctttcataagtagttctgcactgaaatcactgcgctttattgaaataccaggaatctcaatacattttcttataatatcatcaatcttcatttcttgctcctgtcattcgactacctgttttcctttgaattttaattatattatagaattgcaaacgaaatcagtcaacaaaaaaactcggtgctgtttggagctaaaaagataattggttgtagagagccacaactaactgtgctatcttataaagaggttagaaattactaactaaaaaaataaatggaggtactcattatgagtaacaagctacaagcaaaggatctgattaatctcggtctattcacagttctctattttgttatagggtgctgcgtcgccattcctattggatttgtgcccattttcatgccgattctcggagcattgtgggcattgattaccggtattcccttcatgctgttcctgacaagagtgaaaaaattcggcatggttacgatcatgggaattttaagcggtctgctgatgggcttgaccggcatgggattctggggtgtactaacgggtgcgatttttggcttgataagtgatttgattttgaaatctggcggctataaaagtgtaaaaaagagcctgatcggttatgcggtattcagtatttggatcgttggtacatacattcccatgtatttcatggtagaggattcccgggccagctttgcagccagctttggtgaggaatacgctgacaaagtaatggcagttatgcccatgtggagcatcgttctggtaattgctggaatttttgttttcgcaattttgggtggcctgttaggtaaggcactgttgaaaaagcattttgctaaagcgggaattgtgtaatgaacgaggaatcattctttgcaacaactaaaaaaagaaaaggaatattgtttgatcctcgcacaaaacttgtactgctgctgacaatcacaacactgatgttcagtaccagcaacacagggatcatgaacatcgtcaagccctgtttaagccttatcccttttgtgctgatcttatcggagcgccgtttcaaaacagcaggaaagtatttgctattatatgcggtctgtttcgtattggaacggatagccctcacagttttaagtggattgctttctttcattgtgcttgcgattacatccataatgacgcgctttgcacccggcattatgacaggtgcttggttgatttcatcaacttcagtaagtgagtttatcgctgcaatggaacgtatgcacattacagaaaaaattgtcatccccatgtctgtaatatttcgctttttccctacgatcagtgaagaatatcaggcaatacgggacgcaatgaaaatgcggggaatccgtttcggaggaaaaaatccttttttgatggtagaatacaggcttgtacccttaatggtatccgttgtgaagattggagacgaactttctgccgccgcgttaacacgggggcttggtgcccccgtcaaacgtacaaatgtatgtcagattggttttcattttcaagatgtgatagctatcatgctttgcatcctatgttttattctgtttttgtttcagcggcaaattgtgttttaaaaggaggggtgagcctgtgatacagattgaccatgtaactttctcttatggaggagaaaatgagagcgctggtgggattcaggatataaatctgaatatagaggacggtcagtttgtcgtactttgcggtgaaagtggctgcggaaaaacgacaattacccggttgatcaatggtttaattcctcattactatgaaggaaaaatgaacggggaagtatgggtaaacggggcaaaagtttcagagcagcccctttatgataccgcaaaaactgttggcagtgtatttcaaaatccccgttctcaattttttaatgtggatacaaccagcgaaattacattcggttgtgaaaatctcggccagccggaacaaagtattcggaaccggttggaaaaaaccgtccaggatttccgtttggagaaattgatggggcgtaatatttttcatctctccggcggagaaaaacaaaaaatcgcttgtgcaggtgtgtcgattatggaaccaaatgtgcttgttatggacgaaccatcatccaaccttgacgcttcctctattcttgctctgagagctacgcttgcattttggaaatcgcagggaaaaacaattattatatcggaacatcgactctactatctgcgtggtcttgcggatcgttttatttatattactgctggagaggtggaaaaagattattccgctgcagaatttgagcggctgacagaacagcaaagaaccgatttagggttgcgtgccttcattcttgaaaatttattgccacctgaaacagtacagcaaactggaaaacaaatggagctttgcaactttaactttgcctataaaaatgagccgaagacacttcacattcgtgaagataaaattccagcaaatcgtattgtagggattattggaaacaatggagccggaaagtctactttttcccggtgcttttgcggtttggaaaagcgttgcggtaaagttatctggaatggcaagacttaccaccctaaagacaggttaaatacctgctatatggtaatgcaggatgttaatcatcaactttttacagaaacggtgttggatgaaatcttaattagtatggaggaggaaaaccaggaacaagcggaagaaatcctttctaaattagatttaacggatttcaaagacagacaccctatgtccctttctggcggtcaaaaacaacgagtagcaattgcctcggcaatcgcgtctaagcgttctattttatttttcgatgaaccgaccagcggtcttgattataagcatatgaaagaggttgcaaatatcctacggcaagtcagagacgcgggtattaccttgtatgttattacccatgatcttgagttgattttagactgttgtacggatattgttcattttgaggaaggctacattgttgatcaatttcaaatggataaggtcggtcttgaaaaaattagaaactatttcataaagggagcggtaatatgaaaaaagaaaagaaagaatcacccataggtgtcctatggggatggggaaaatcttatcatgggaaattcataagcagcattatccttgcagtattaggcgtgacctgccagatggtgccctatttttgcgtggcgcatattgttacgctgatgctggctggggagcagaatctttccttctatgtgaccgctagcattattgcattatgcggctatttggggaaagtgctgttttcctgcctttctacaacggtttcccacacggcgacttattacacgctacgcgacttgagggagaatatcacagtaaaactggttcatgtcccgatgggaacgattttggatactccgtctggtcagtataaaacaacgattgtagaccgtgtagagggaatggaaccgacctttgcgcacctgattccggaaatgactgcaaatgttctgataccacttgtgattgttgtgtacctgtttattctggattggcgcatggcgcttttgtctcttgttactctggtgatggggcttgttgttatgtccgccggtatgaagaactatcccgttaaatgggaaggtgcggtaaaagccggaaaacagatggcaaatgccattgtagagtatattggaggtattgaggtggttaaagcatttagtcaatccgccggttcctacaaaaagtattccgatgcagtaaactataacgccaactactatgtggattggatgagagaaaaccagaaaactatgagtgcctacaatgccattctgccctcagtgctaatctgtgtgctgccttgcggttttgcgttctggctttctggtagtctggaactttctacttttctttctattataattttctcgctggggctggttggaccaattatcgcagcctttacttttacagatgatttggcagtactggggacaaatgtggaagaaatcagccggcttttgaacgccgaagaactgaaccataaggacacgccggttaagctggaagataccggtattgttttcggacatgtgtctttttcctatgacggtataacagaagttctgcatgatgtgaaccttgccattcagcccgggaccatgacagcccttgtaggaccatctggatccggaaaatctacggtggcgaagctcattgccggatattgggatgttacatccggcagtattacactcggtgaccacgagatgaaggatataccgctgtctgaaattgcagatcagatttcctatgtatcccaagacaattacctgtttaaccgtagcatccgggagaatatccgcatgggaagacccagtgctacagatgcggaggtggaacaggctgccagacaaagcggctgtgacgcctttatccgcaggctggataacagctatgatacggttgtcggtagtgctggttcccacctttccggcggcgagcgccagcggattgccatcgcccgtgccatgctaaaaaacgcgccggttgtcattttagatgaggccactgcctatattgaccccgaaaatgaggcgctggtacagaaagccatttccgctttgactatcggcaagaccctgattgtgattgcacaccggctgtctaccattgttgacgcagacaacattgttgtggtaaaggatggaactgtccgcgcacaaggtacgcatgagaaactgctggaaacctgccccctctaccgggatatgtggcaggcgcatatcggcgcgaaggaccagatgtaagggggatgtcagatgtatggaacattgaaaaaaatttttgcttttgcaggcagcaagaaggggctgctaaaaaaatctctattgtttgcattcctgtctgggctgttttcagccctgcagtttgccgccctctttgtggtaataggcgcgctagtatctaacaaccgggacggacagtttatctggatttcactggggattatgggcgtttcccttattgggcgtatcattacgacctatttctccacgatgaagcagacagaaaccggctattgtatggtggcagaaaaacgtatccatataggagatcggctgcgctatatcccgatgggctatttcaacaagaatagtatcggggatattactgccgttgtcacaacgactttaggagatgtagaaaactcggcagcccgtgttttggtatctgtactggggggattttttaattcggtggctttggttattgtcctgctgatattcgactggaggattgggcttgtagctgttgccggtgtcctgctttaccttgcagtggcggaactggctctccgaaagtccgcagctcaaagttcggttcgtcagcacacacaggagtcccttgtgacctccgtgttggaatacatccagggcatgggaatcgtcaaagcatttgggcttgaaagggacagtgcacaatccatcagaaatgctattcaatcaagttgccggaataatctgaagctgacaaaagccagcattccctatgacgctatcaaacaagtggttgtccgggtgttcagcatcctgttgttactggcttcaatctggctttggctgggcgattctctgccgctggtctacggcttgattttagtaatagcttctttcatggtgttcaatgatttggaaaatgccggaaacatggcttctttgttgcaaatgttggcggcttcgatggacacggcaaatgccattgatgatacgccgataatggatgagaaaggcgctgacattacccccaaaaccagcgagattgtgtttgataaggtggatttttcctacgcagaccgcaagatattagatcaggtcagttttactattcctgagaaaacaaccacagccattgtcggtccttctggtgcaggtaagacaacaatgtgtaacttgattgcccgtttttgggatgtagactccggaaaaattaccattggcggtatggatgtacaggatttcaaactggatagtctgatgaagagcatttcaatggtgtttcagagtgtatatctctttgcagatacgattgagaacaacatcaagtttggttgccaggacgctactcatgagcaagtggttgaggtggcgaaaaaagcttgttgtcatgactttatttccgctttaccggacggatatgacactatgataggcgagggaggcggtactttatccggcggagagaagcagcgtatttccatcgctcgtgccatgctgaaaaacgcgcctattatcattttggatgaggcaacaagtagcgttgatccggagaatgaggatgaattgcagcatgctattgaggcactgacccatgataagaccatcattatgattgctcaccggctgaaaaccgttcggaacgccgaccagatacttgtactgaacaacgctcatattgtacagagaggcactcatgcggaattgattcagcagagtggattgtatgctgactttatatccgctaggaaggaggctataggctggaaattggcggagtaaaggagagtcttatgaagatttatgaatctagggaagattatttggaaacgatactaattcttcagaagaaaaatggtatggtacgttctgtggatgtagctgaatatagagaagtatcaaagcccagtgtatgccatgctgttgcagttttgcagaagagcggctttattagaaaagataaaaatggttttctttccttgacagatgcaggtaaaaaagttgctgaaaaaatttacgaacgacatttattttttacagaaaagcttttggctataggagttagccgtaaaacggcagagcaagatgcttgtcggatagaacatgtaatcagtgaggaaagttttactaaattaaaaattgcttgtataaaattaaaatgaaatgacttgatttttacgactctggagaaatttcagggtcgttttttgaaaattactatagaaaaataaagcgaaggggagcaatctgagtgacgatgatgagatgaaagacggagaagaactgatccggtattataagaataacagggaagggcttctgccataccagtcgcagggccttgaactgccggaaggactggaatactgaaacatggaaacaatggagaaccatatgtagagtgtaattgcaaagcggatgaaacacgggcacaggagttggagccgacaagggggaacccacctagcaaagattctagcgaaaaaatgcagtggaaaactgtatgaagtgacagaacgcttgaacaagtgttcaggacttttatgagttttggctagaggaagtcaaaaagaagtcgctttcctataattcttattattcttataagaatgcgattcaaaattatattttgccattgtatgggcggctatctatggggaaattgcggaaaaatcatgtaaagagaatttataaaaaaacatatgacaaatctccatcagtagcgaaaattttgaagactgtgcttacaacttctttcaagtatgcattgtgctatggatatgtggaagaagattatgtatcaggattaaaatggaacagagtcataaagaaattatcaaaaagcggacagaagaaagcgctgacaaattcaggaaaggaaatatatgtaagaggttacaacaaatgataagatggattatttgatttctgaaattgaaaaaacggtagcagttgccaaagaacacctcacaggtgccgttaatcaaacaatgacagaaatatattggagaataggaagatatattgttgaatttgagcagtctggaaatgaaaaggaaatttatggaaaaaattttcaggaggaatatgattttaatacctcttctttgtcacgacaaaaacagtggcatgaaagtgcttgagggcaattgctacgataaactgcggcaaagcagtgcaataggactggtgggatactacaattttactacgattgaggaaaccaaaatcagaagtgcataataatggtccgggagattgagaattggtatctttcggacttttgtattattccgataagtggaaaatattattccgatactgtttatattgttccgataatagggtatactactgtttgaagagaggtgtagatttatgtacatgacagtgaaacaggccgcagaaaaatggggcatttcagatagaagagttcgtatattatgttcagagggaaaaattttgggtgttacccgcgaagggcgcagttggaaaattcctgtagatgcgaagaaaccggaggacggtaggtataaaaaagcagagagtttgctggcggtaattgacaggaaaaaaatcgaactggattccagacgacctttgacagcgggagaggtggaacgactgacagaggaatttgtagttgaatacacttacaattccaatgcgatagagggaaacacgctgaccttgcgagagacggatatggtgttgcgtggtttgacgattgatcagaagccactgaaagatcatatggaagcggtcggacataaagaagcttttgattttgtgcaggatttggtaaagaatcaggtaccattatcagagagcattattaagcagattcattatctggtgttggctgataaaaaggatgaccgaggtgtttacagaagagttccggtaagaattatgggtgcaaagcatgaatcagtgcagccatatctgatacagcctaagatggagcaactgctagtgtcttatagaaataacacagagcatatcattccacggcttgcacggtttcatattgagtttgagggaattcaccctttcattgacggaaatggccggacgggacgactgcttatgaatctggaattgatgaaagccgggtatcctccaatagacattaagtttacagatcggattgcttattacaatgcgtttgatgaatatcttgtaaatcataatctggatgtgatggaaaagttgtttgctgggtatgtgaataaaaggttggacagctatctggcaatgttggatgagtgaaaatattaaggaggtgtgggaatgtttgtttcagaataatttggcatttgaaatagcagaccaatatagcgatagacctatggagtttttgaagtcattatatgatatttcattttatgtaccgggaacttatgcggagacatggaaaattatcatggaaaatggaaattctttaaagcgctatttaacgtgtttttattttgaaaaaatagggattatgattgaagaatagtctgttgctatatagctatttggcgcatatcattgcagaaacatatttgttatgacaggaattttaaattgtatgattaaaagcacgcataaaatcaattgtaaaaaaatacgattgatttatgcgcatttttatttatactataaacagtgaaactggaaaggaagaacagtgtatgcgtgaaacaagaacaacagggtttaaagaaaagattacaaatatattttaaaaacagtaagtgccttttcaaattacgatggtggagaagtgttttttggcatcgatgacaatgggaatatcaaaggtctgtcagatgtaaaacaagcatgtcttgatatcgaaaataagattaatgacagtattactccgcagccccattatacgctggaattgcagaatcacgacagaacgataaaactgactgtaaaaagcgggatgcaaaagccttatttatataaatcgaaggcatataagcgaaatgatactgcaaccatagaggttgacacactggagttgtcaagactgattttggaagggaaaaatatcagatttgaagaattgcgatgtgaagagcaaaaactgacatttaataccctatgtcaaaaattaaaagaatatattcagattgaaacttttaatcaggacaccttgaaaacgttgaacttatacaacaatactattggatacaataatgcagatggtattttggcggataaaaatcattttccaggaattgatatggtgaagttcggtgaaaacatcagtgtgattcataagagggcaacctttgatcatatatccatttttgaagtctacgaaaaaactgcagaggtgttcaaggattattatgaatatgaagaaatacaaggcactgacaggaaaaagatagaaaaaataccggaggctgcctttcgagaagcaatcgcaaatgcgctgattcacagagcgtgggatatggattcgcagatcaaagtttcgatgtttgatgacagaatagaaattatttctccggggggactgccttctggaataacagaagatgaatagttatcggggaaactttcgattttaagaaatagaaatcttgcaaatgtattttacagacttgggtttgttgaaatcttcggtacagggattacaaggataaaacagctctatgaggaaggcttgatgaagccggattttgaagtgtcggaaaatacaatcaagatcgtactcccggtttttgagaaaaacctgaatttaacggaagacgaaagaaaaatatataagattctgagcaggacaatgctgaaatccatcagcgaaattgctccttatgccccatttggcaaatcaaagacaacacagttgctgaaagatatggggaagaaaggtgttgtaaaaattgaaggcaggggaagaggtactaagtatatgataaagtaattaccatgataaagagtaatgatgtaagctttgtctatattttccgttttgaaaaaatgtaaattcaacagccttgcagagtgtaaaggtgcttgcaacattgttttcaaaaaatgctttgatgtggtcttggcatataaaaatgcaagtagcgatattccttaggcggatatgataaatattactgtatatcctgcattaaatctcgacagggcagcaaaaaataatcttaaaaagaaaaattgacacgaaatagaacataagataaaataaaagcagaacatttgttcctgggaaaacgacgataaaaatagccgctttgcaaccaaaagtgtgttttacgattttattagaaaaaggatattctgattacacgaaaaattcgtgtaatcactaatcaagtattcaaaaataacaaagggagaagcaggtatgagtgaagaaaaaatctttaaattagtatctccatatcagcctaccggcgaccagccgcaggctatcgcccagttagtacaggggttccaggagggaaaccagtgtgagacacttcttggggttaccggttcgggtaagacatttacgatggcaaatgtcattcagcagttaaataagccgacaattatcattgcacataataagacattggcggcgcagctttacggagagttcaaagagttcttccctaacaacgcagtggaatatttcgtctcctattacgactactaccagccggaggcttacgttccatcatcggacacctatattgccaaggactcggcgattaacgatgagattgataaattgcgccactcagccacagcggcactgtccgaaagaaaagacgtcattatcgtggcgagtgtgtcctgcatctacggactcggcagcccgattgactatcagaacatggtgatttccctgcggcctggtatgataaaggaccgggatgaagtcattgggaagttgatcgacattcagtacgacagaaatgacattgactttaagagaggcacgttccgggttcatggagatgtactggaagtatttccggccggttctggagagaatataatccgggtagagtttttcggtgatgagattgaccggattacggaagtggactctctgacaggagagattaaaaatgagctgaatcatattgcgattttcccagcgtcccactatgtcgtatccaaagagaatatggagcgggcaatcggacagattgaggaggagctgggacatcagattcgtttctttaaaggtgaggacaagcttctggaggcgcagaggatttcagagaggacgaattttgatattgagatgcttcgggagacgggcttttgttccgggattgagaattattcccgtcatctgacagggcttgcagagggcgagccgccgcacacgcttctggattattttccggatgattttctgatgattattgacgagtcccacaagacgattccacagatcggtgggatgtaccatggagaccagtccagaaaaaccactctggtggactatgggttccgtcttccgtcggcaaaggacaatcggccgctcaattttgaagagtttgagagcaagatcagccaggtgatgtttgtatcggcgacgccgggggcctatgaggaggaacatgagcttctgcgggcggagcaggtaatccgtccgaccggtcttcttgatcctgaggtggaagtgcgtcctgtagagggacagattgatgatctgattggagaagtcaataaggaagtagctaagaagaacaagatcctcattacaacgcttactaagaggatggcagaggatctgacagattatatgaaagaattgggaattcgtgtgagatatcttcattcggatattgataccctggaacgaacagagattatccgggatatgcgtctggacgtctttgacgtactggtgggaatcaatcttttgagggagggcctggacattccggagattacacttgtcgcaattctggatgcggataaagagggattcctgcgttctgagacgtcattgattcagacgatcgggcgtgccgcaagaaatgcagatggacgtgtcattatgtatgcggatacgataacagattctatgcgggcagccattgacgagacaaggagaaggcgggagcttcagatgcgttacaatgaggagcatggtattaccccgcagacgattcgaaaagcggtgcgggacctgatcagcatttccaagaaagttgcaaagcaggaagaagtgctggagaaggatccggagtctatgagtcgggaagagctggagaagctgatcaaagatctgcagcgacagatgaaaaaagcggcggcggatttggattttgagacggctgccaagctgcgagacaatatgattgaattaaaaaagcatttgcaggaaattgaagaataaaagaagggaaacaacaatggacaacagacaatatatccgcatccgcggagcaaatgagcataatctgaaaaacatcagcctggatattccaaggaatgaactggttgtactgacgggcctgagtggttccgggaaatcctctttggcgtttgacacgatttatgcagaggggcagagacgttacatggaatcactgtcctcctacgcaagacagtttctgggacagatggaaaagccgaatgtagagagtattgagggactttccccggcaatttccattgatcagaaatctacgaaccggaacccacgttctactgtaggaacggtaacagagatctatgattatttccgtctcctgtatgcgagaatcgggattccacactgcccaaattgcggtaaggagatcaaaaagcaaacggtggatcagatgacagatcagattatggaactgccggagcggacaaaaatccagcttctggcgccggtcgtgagaggacggaaaggaacccatgccaagcttttggagaaggcgaagaagagcgggtatgtccgggtgaggatcgatggaaacatgtacgagctgacagaggagatccgcctggaaaagaatatcaagcataatattgagattgtggtggaccggcttgtggtaaaaccggggattgaaaagcgtctgaccgactccatcgagacgactctgaatctggcggagggattgatgactgtggacgtgattgacggagaaccgatcaatttcagccagagcttttcctgtccggactgtgggatcagtattgatgagatagagccgagaagtttttcgtttaacaatccgtttggcgcctgcccggaatgttttggactaggatataagatggagtttgacgaggatctgatgatcccggataaatctctgagtatcaatcagggagcgatcgcggcgcttggatggcagtcctgtatggatccatccagttttacaaatgccattttgcgcgctctttgcgaggaatacaagtttgatctggatactccgtttgaagagtatccgaaaaagatccatgacgttctgatctatggaacgaatggaaaggaaatcaaggtatattacaaaggacagcggggcgagggcgtctacgacgtggcctttgaagggctgatcaaaaatgtagagcggcgttaccgggaaaccgggtccgacgcgatgaaggcagagtacgaaactttcatgcgaattacaccgtgtcatgcctgcaaagggcagcgcctgaaaagggaagcgctggctgtgactatcggcggcaaaaatatttatgaagtaacagctatgtctattgaaaatcttcaggaatttttaaatgggctggaactgaccgaggtacagaagatgatcggaggacagattctaaaggaaatccgttcccgcatcgggtttttgatcgatgttggtctcgagtacctgactctttcacgggcggcaggcagcctgtccggcggggaagcacagagaattcgtctggcgactcagatcggttccggtctggttggtgtagcctatattctggatgaaccgagcattggactgcaccagagggacaatgacaagctgcttgccactttgaagcatctgcgggatctgggaaattctttgattgtcgtggagcatgacgaggataccatgcttgctgcggattatattgtggatattggtccgggagccggggagcatggcggagaagtcgttgctacggggaatgctcaggagattatgaatacgcctggttctgttaccggagattacttaagcggaagaatccgaattccggtgccggaaaagagggcggtgccgaccggatttctaaagattgtcggggcaaaggaaaataatctgaagaatatcaatgtagagattccgcttggcgtgatgacctgtgtgacaggtgtatcaggttcagggaaaagttcactgatcaacgagattttatataagaaacttgcgaaagtattgaatcatgccaggactattccgggaaaacacagggagattcagggcctggaaaatcttgacaaggttatcgatattgaccagtcgccgatcgggcggacgccacgatccaacccggcgacatacacgggtgtttttgatctgatccgggatctgtttgcggcaacgccggacgcaaaggcgaagggatacaagaaaggccggtttagcttcaatgtcaaaggcggccggtgtgaggcgtgcagtggggatggaattttaaagattgagatgcatttcctcccggacgtctatgtgccgtgtgaagtttgccatggaaagaggtacaaccgggagacattggaggtaaaatataaaggaaagagtattttcgacgtgctgaatatgactgtggaagaggcgctgaccttttttgaaaacgtgccgagtatcagacgaaagatggagacactttacgatgtggggctctcctatatccgcctgggacagccttcgacaacgctgtccggtggggaggcacagcgaatcaagctggcagcagagctgagcaagcgcagtaccgggaagactgtctacattctggatgagccgacgacgggacttcattttgcggatgtccataagctgaccgagattctcagaagactggcggcggacggcaatacagtcattgtcattgaacacaatctggatgtcattaagacagcggattatattatcgatatgggaccggaaggcggagacaaaggcggaactgttattgcgaaagggacgccggaggagattgtaaaatgtccacaatcccatacagggcgatatctcgcgccattccttaaagaatgaatatgtaacagttcagccacacagctcggattagccgctatgcggctttaaacgccacttgcgtggctaaatcctcgctgatggcagaacgccatatacaaagtacacaaaaaatcttcgttttcaaacaagttgaaactcagatttttgtgactttgtgtatggctgaactgttacgaaatttacagattatgagaaaaaactctttccatttccaggaagattgattataataacaaatgtatgcgtagaaccagaggtttatgcgttctgacatacgaaagaggaagtataatagaccaaagaggagcgaatatagatggatttgcgaaaggggtttagttcatggcggtagtagatattgggattgaccttgggacagcgagtgttctggtatatgtgaaaggaaagggtgtcgtactcaaagagccgtccgttgtagcgttcgacagagatacgagcgagattcgtgcgatcggggaagaagcaagactgatgcttggcaggacgccggggaatattgtagcggtgcgtccgttaaggcagggcgttatttctgattacacagttacggaaaagatgatcaagtatttcgtgcagaagtcgcttggaaaacgtacgtttaagcggccacgcatcagtgtctgtgttccaagcggtgtgacggaagtggagaaaaaggcagtagaggaggcgacttttgcggcgggagccagagaggtgcatctgatcgaggagccggttgccgcggcgatcggggctggcatcgatatttccaaagcatgtggaaatatgattgttgacatcggaggcggtacatcagacattgcggttatctctcttggcggcacagttgttaatacatcgctgaaagtcgcgggagatgattttgatgaagcgattgtgcggtacatgagaaagaagcacaatctcctgatcggtgagcgtactgcggaagatatcaagatacggattggtacgacgtatccgcttgtggaggatgagacgatcgaggtgcggggacgaaatcttgtgacaggtcttccgaagaccgtgacagtttcttcttctgaaacggaggaagcactgcgtgagccgacaagccagattgtagaggctgtgatcggagtgctggagagaacaccgccggagctttcagcggatatcctggacagagggatcgtcctgacgggcggcggagctctgcttcgtgggcttgaggagctgattgaagagcggacaggaattcatacaatgactgcggaagatccaatgcaggtcgttgccatcggcaccggacagtttgtcgaatttatgagtgagaacaaaaagtttcatgtatagaagtcacaacaaagggactgctgcgggagaagagtacgagtttcgcggcagtcctgttctattcttaaaaaaggccgcaaacggcagtctgaagcagcccgacggcgggtgacagcgagctgaagaacggcagatggaggcacggtttggaaaagattacaggatatatcgaccatatcatctttcggaatgaggataatggatatacggtatttcaattaaataatgaagaaggagaactgacttgtgtcgggaagttttcctatatcggcgagggtgagtttttggaactggaaggagaatacaccatgcatccgtcctatgggatgcagcttcaggtgacaaatcacaggatcaaggagccggaggacagggaatccattgagagatacctaggttccggagcagtcaaaggaatcgggcccgcgcttgcagggaaaatcgtcgccaaattcggggaagatacgtttcgcattatggaagaagagccggagcggctggcggagatcaaaggtatcagtgagagaaaggcaagagagatctgtgtgcaggtggaggagaaaaaagacctcagacaggccatgatatacttgcaaaaatacggaatttccattcatctggcggttaagatttaccagaaatacggacttggcacctacagtgttctggaggagaatccgtacaagctcgcggacgacattgagggtgtcggctttcggacagcggatgagatagcctcgcggatcgggattcacactgattcggatttccgtattcagagtggcatcttttacacgttgctccaaagtgtgcaggagggacatgtatacttggaagagaatgtactgtcagagagagcggcgcagcttttggaggtggagctgaaagatattgagaaatatctgatggatcttgcgatggccaaaaaggtggttctgaagcaggatggagaaaaggtgcgtgtctatccggcccaatattactatatggaaatgaacacggcccggatgttaaaggagctgaatataaactatgacgaaccagatgatctgatccgcagaaggattgacaagctggaggaagagacagaatctacattggatgaacagcagaaaagagcagtggcggaggcggtaaagcatgggatattcatcttgaccggaggacctggtacaggaaagacaacgaccatcaatgcgatgatccgttattttctaagtgagggaatggatatccgtctggcggctcctaccgggcgtgcggcaaagcggatgacagagacgacgggttatgaagcgcagacgattcatcggcttttagaagtaagcggcagtccggaggagagcagcaaaggtggatttggaagaaatcaggacaatccgctggagacggatgtggtgattattgatgagatgtccatggtggatcttgcattgatgcacgcactgttgtcctcggttgttccggggacgagagtgatctttgtgggcgaccgcaaccagctcccgtcggtgggaccggggaaggtccttcaggatctgattgagtcccatgcatttccggtgatgatgctgacccggattttccggcaggcacaggaaagtgatatcgtcgtcaatgctcaccggatcaatgcgggggaagaagtgcgtctggataataagagcagggatttctttttcctgaaacgccaggatgcggacgtcattatcagtgtgattctgactctgatccagaaaaaactgccccgctatgtaaaggcgaagatgacagatattcaggtgcttgctccaatgaagaaaggactgcttggagtggagcggctgaaccggattttacaacaatatttaaacccgccttctgtcaaaaagcaggagaaggaatatggggaaagactgttccgtgtcggagataaggtcatgcagacgaaaaataattatcagcttgagtgggagatcgcaacgaaatacggtctggttgtggacaagggcgtcggagtttttaatggagatattggtatcgtgacggcaatccatacatatgatgagactgtggaagtagagtttgacgaaaaaagaaaggtaaaatatccgtttaagatgctcgatgaactggagcttgcttatgcgataactattcataaatcacagggaagcgagtatccggcagtcgtcatcccgctgcttgcgggaccgagacagctttattgtcgaaatttgctgtatacagcggttacaagagcgaaaaaatgtgttacactggtaggaaacgaaactgtttttcgtgagatgattcaaaatgtggatgagcagaagcggaatacgtcgcttgcagagcggattcaggagattttgtagggagacaaatcatctgatcgggggaagaatcagaagaaacacaaatgaatatcgttgggaaactgttatacccagacgtatgtcctttctgtggaaaggcgtacacaaaggggatttgcgaagactgtaagaaaaatcttttttgggcgagggagccggcctgcaaaaaatgcggaaagccactccgggatgagagggtggagttctgtaaagactgcaaagagagggtggaaacgggaatgtgttactatgaccgtggacggagtctctgggttcaccgcccgccggtgagcggatccgtctaccagtttaagtttcacaaccgtagagtgtatgccaggtactatgccgaggtgatgaaagagcagtttgatagattgatccggaaatggaacgtacaggcgattgtgccagttcctatggatcataagaaaaggcgcaggagaggctacaaccaggcagaagttctggcccgggagcttggaaggataacgggaatcccggtggagagaaagctgcttcataagagaaaatccagggcagcgcagaagacattggaccgccgtggaagagcacataatcttgatgggagtttctgggttgaacgtcaaaccatagctctggaaaggatacttttgattgacgatatttatacgaccgggaataccgtgaatgaagcggccaaaatactgaaaaagtcgggagtgcggcaagttttctttttaacgataagtattggacaagatatttgatttttgatatactgaacatagtttttctgatgacaggaaggtggaatatggttaacgaagaaaaagtaaagttgatgaataagatggcactttatgaagaaaagtatggaaaagaggatttcaagatcgcttcttactataaaaaggattatgtcagctatcagacgatttttaccgttatctgggtcacgattggttatgtggttctgtttggagtatttgcggcggcatttgtagagacctttctgagcaacgtaggtctgttcgcgattgttctgtttgtacttgcggccgttgcgctatatctgattctcgttgtttcttatggactgtttgcgtccagattttatcagaagaaacatatcagagcaaagggaagagtaaaacgctatatccgtatgctgacgcagctggataaattctacagcaaagaaaggaagaaaaagaatgagtaatttatttgtcctgaaggagcagctgcaggctttctatgcgaggtactcaaaagaagtggataagatcgtgcattttcttctcgcgtttatagtattttatctgatcaattcgaagatcggttacatggaagcagtttcaaatccgattgttgccctgatcctggcgctgatctgtgcgtttttgccgggaacactgacagtcctggcggcggctgtcctgattctgattcatatttttgccctgtccatgggagtgatggcagtaacggcagcactttttgcgattatgttcattttttatttccgatttactccggagacgtccatgatcgtgctgctcgttatggtagcgtatctttttaagattccctttgctgtcccgatttcctttgcgcttatggggacgccaagctgtatcattccgattatttttggtacgatgatttactccatgatcagctatctggagacatcggctacagcagtgaccggtgccagcggaatggcaggggagatctctctgtttgcgtcccggattctgcagaataaggaaatgtggatctacatcgcatcgtttgttgtagcggtactggttgtctatacactgagaaagagtgagtttgatcagtcctggaagatcgctgtggcatcaggggctgtggcggacatcattgtgattgtggcaggaagtattgttttttctactccgatcgactatgtgacgctgatttttggaaacatgatttccgtcgcactggcgctgattttagagtttttcattttttctgtcgattattctaaagcggagaagttccagtatgaggatgatgagtactattactatgtaaaggcgattccgaaagtatccgtggcagttccggaaaagcgcgtgaaaaagatcagcaggcggaagacggatctgagaaagcatgaaagtaaatcgaaagagcatccgatgaaggaatcatcggaaacttcgccggctccggcagaaaaaccggcagaaaagtcctacataccgggaatgacggaggagatgctcctggcaaagcagctccaggaagagatggatctggaaaagattctgaaaaatgagctggatgataaagaagataagtaaaaatacagacaaagaagaaaaatcaaaggggaaaatcatgggtgagtataagaggatgggaggtgacaggagtgaacaaccggttttttgaggcgctgaggggctattttccggactggtatcttccggatgtttattggacagatatcgttgagattgtgattgtggcgtttctgatttatcagcttatggtctggattaagaacacgaaggcgtggatgctgttaaaaggaattctggtgctggccgtgtttattcttgtcgcggccatactgagaatgaatacgattttatggattgcaaggaacagtgtgtcgatccttgcgatagcggcgattgtggtgtttcagccggagcttcggcgggcgctggaaaagcttggggaaaagcggttccttacagcgattgtgccgcttgataaggggaaagaaaatgaacgtttcagcagccgcacgatcgattcgatcgtggatgcatgttttgctatgggaaaagtcaagaccggagcactgattgtagtagagcaggccatccgtctgacggaatatgaaagtaccggtatctatctggactgtatcgtatcttcccaggttttgatcaatatttttgaacacaacactccgttgcatgacggtgcgattatcgtaagagggaaccggattgtgtctgcgacctgttacctgccgctctcggataatatggagatcagcaaggaacttggaacaaggcaccgggcagctctcggtatgagtgaagtcagcgacgcacttgttattgcggtctccgaggaaaccggttatgtctctgtagcacagggcggacagctcgtgcggaacgtgacgccggaatacttgaaggagagtctgattcggattcagacgaaaaatacggagaaaaagatagcgagactgtggaaaggaaggcggaaacatgaaagagaaactgactaacaaccttgctttgaagctgttgtcgcttgcccttgccgcattcctgtggatggtggtcgtgaatcttgacgatccggtcacatctgtacagttttctaatgtaccagttgagattctgcatccggaagttgtgacaagcaaaggaaaaacctaccagatcgaggatgagaccgatactgtccgggtgacggtgcgtgcgaagcgatccgttcttcatagtctgagggttcatgatatcaaagcctatgcggatatgaaagagatgtcccttggttcccagattcctatcgaggtatcgatcccgggagttgaatattcagaagcatactcaaatcctaggaatcttcaggttacaatcgaagatgaagcgcagaatacgtacccgattacaccgacgacaacaggaagtgtacgggacggatatgtgctcggagagatcaaggcggatccggaaaaagtacgtgtgaacggtccgaagtccattatcgaacggatcgacaaggtcgtggcggaggttgatgtgaccggactcgcgtcggataccgtgttgcagtccaagcttgtattctatgacgcggatggaaaagcgattgataatactttgttgacgcttcaggacctgaaggatgaaaatgatgtcagagtacaggtggaagtaaggaatacaagaagacttcaacttgattttgatacatcgtatattacggcagcggacggttacctgtttaccggaattgagacagagccaaaagaggttcaggtatcaggaagcacagatgtacttgaggatcttgacaaaatcgagattccggcaagtgcattgaatatccgggatctggacagcaaggaagaggttgtggtggatattacgccatatcttccggatggagtcgaattgatcgacgagaatgcgggagctgttgtggtgacaatcggaatcgaggaggaaggcagccggacgatcgagattccaaccggagccattgtggtaaacaacctgcaggacggacttcagtattcctatgtatccggaaacaacctggagatcaaggtacagggagatcaggagcttttggatgctttggagctggatgagggcagcttgtctatcaatctggtgacctacaaagagccgggagaatatgatgtcccggtagaagtgaagcttccggaaggatgctccttggcggagaatgttgtcatcaaggtcagactggagcaggtggaaaataaggaaagtgaataactggaggagagcgatatggttagccggaaagtcgttatcagcaatcccacaggactgcatctgagaccggcagggctgttctgtaaagctgcggcagagttttgctgcagtgtcaaattccgtacggataagggaatcagcagtgcaaagagtgtgctcagtgttctgggagcctgcgtgaaatgtggcgatgaaatggagattatctgcgatggcgtggatgaagagcaggcacttgagacaatggtagcgcttgtggaaagtggattgggagaatagaaaaaagaatgaggagtgtgagataacatgctgaattatcagagatacaaaagagtaccggttgttccgtatccggaacgtacctggccggacaaagagattgagaaagcgccgatctggtgcagcgtggatttaagagatggaaaccaggctttaattgagccaatggtggtggaagagaagattgagatgttccagttgctcgtaaaattgggatttaaggagatcgaagtggggttcccatcagcgtcccagattgaatatgacttcctgagaaagcttgttgaggatgatcttattccggatgatatgtggattcaggtattggtacagtgcagggagcatctggtggagagaacatttgaagcactgaaaggtgtgaagaatgcgattgtacatatttacaactccacgtccacactccaaagagaggttgtatttaagaaagaaaaggaagaaattaagcagatcgccattgacggcacgaagatggtgaaaaaatacgcaaaagatttcgaggggaatttaagaatcgagtattctccggaaagctttaccggaactgaacttgattatgccctggaggtatgcgaggcagttcagaaggagtggggagcgacaaaagaaaatccaatcattataaatcttccggcaacggtggagatgacgacgccgaatgtatatgcggatcagattgaatggatgcaccgtcacttcagtgaccgcgagagtgtcattttaagtattcacccacataatgacagaggtacaggcgttgcggcaaccgagcttgcacttcttgcgggagcggatcgtgtggagggaactttgtttggaaacggggagagaaccggaaatctggatattctgaccgttgcctacaatatgttttcccagggaatcaatccggaactcaatattgaaaatgtaacagagatcaaagaagtatacgaaagatgctgcaagatggatgtaccgatgcgccatccatatgccggtaaactggtatttaccgcattttccggatctcatcaggatgcaattaacaaaggaatgaaggccatgcaggagagaaggcaggaatggtgggaagtaccatatcttccgatcgatccatccgatatcggaagagagtacgagccgatcgtccgcatcaacagccagtccggtaagggcggcgtagcctttgtaatggacagcgagtttggatataagcttccgaagcggatgcataaagagtttgccgacgtcattcaaaagattgcggaatcccagggtgaagtggctcctgcaacgatgatggaagtatttgagaaagagtatctccgcaggaaggcaccatatgaattcatccgtgcaaaagcagaggatgtggcggaaaatgagacggagatcgaagtggtcttcatggcaggtcaggaattaaagagtgctaaggcagtaggaaacggacctcttgccgcactgaaaaagctgatgacagaggaatctggaatggactttactctgatcgactactcacagcacgctcttagtcaggggtctgaggcaaaggcggcagcctacatctgcctgcgcgacaaccgcagcggaaaagagacctatggagttggcgtcagcgccaatattacacgggcaggtttccgggcgtttttcagcgctgtggacagactgatggaagaaaagtaagggaaatcaacataataaaaggagacagacgatgagtaaagcagctttagtgattatggccgcaggaatcggcagcagatttggaggaggaattaagcagttggaaccggtcgggccaaatggggaaattattatggattattccatccgggatgctgtggaggcaggatttgacaaagtaatatttgtcatccgcaaagatctggaaaaagattttaaagaagtgatcggaaacagaattgaaaaacagattccagtggagtacgcttttcaggagctcgacgatattccggaaacattccggacgaaattccaggaaagaacaaagccgtggggcacggggcaggcgattttggcgtgccggggcaaggtgacagagccttttctcgtcatcaacgcggatgatttctatggcaaagaagcctatgcggaggcatatcagtatctcaaagaaaacagagaaaataccgggaaagaaccaatctgcatggtgggctttgtcctgaaaaacacgcttagtgaaaacggcggagtgacaagaggtgtctgtgaggtggatgaaaatggtatgctcaccaacatcattgagacacacaatattgtcagaaatggggatcatgccgaggcagaggacggagcaaaacggctcgaacttgaagctccggtttccatgaacatgtggggattacagccggaatttctgaatattctggaaaaaggtttccaggaatttctggaaaaaacagatgccaaggatctgaaagcagagtatcttctgcctaccatcattggcggacttcttgcggatggacaggctgaagtcactgtgctgcagtccagggataaatggtttggggtgacatataaagaagacaaagagagtgttgtcaatgcaatcaaagaattaattgagagcggaatttactagaaaacgttgattatgtaagaaaagagagaagatgaacatggaaattttcctgttgcatgttctctttttttgtattcataagactcttggaaattttatattgagaaaagaaaatgttacatcacttaatggaggaacaggggaattcagggaaattccggcggaaatattacgaaattattacaagataagaaatttttaaggtctaataacttgcggaaaggatagaaatcttatataatatagagagttttagaccagcgaggtgttttatgaaacgagaactgaaaaaatttgaatcaaccatgtggttgtgtatcaaattattattatatattttattgatgggcacctttatgttcattatgtccagagaaaacagggctttgggcgttctttccagaacaatgggtatcacattttctacctattgtgttgtgggactgttgtttttgaatatttacggcagatatgatgtgggacggagaaagagtaagccaatcatctattccctttctttggcggttctgtttacagatgttgtgacatatatccagttgatgattatgaatacgatcactccgagcatttatgctttccggttggacagccttggatcactgctcctgagttttcttgttcaggttatgattatcatcgtatttgcctacggtggaaacgggctgttttttacgattcataagccggaaagctgctgtatcgtgacttcgtcccaggagagcctcgacaatattgtcagaggaattctaaagtataagaaacagtacaagatcgactacatcatggactataaagaaaagaatctgtttgagacagtgggaaaggcagatactgtcttcatccatgatgtaccgttggatgttagaagccggattgtccgtttctgctataaaaataagattaatatttacttcaatccggagattgaagatattgtggagatgagcgcaaaatactatctgctcgatgatgtctctgtactcaacgccaatgtgaaagcgtggacaatggagcagagggtaatgaagaaacttttggacatgtctctggctattgtgcttgggattctgacgtcccccatctggattgtaagtgctatcgcaattaaagcttatgacggcggacatatcttctttaaacagaaacgtgcgacactgaacggacgtgtttttgaagtatataaatttcggaccatgaaagaacatgtggagaaccattctgtaacggatgatgatgaccggattaccaaaccagggaagattctgcggaagatccgaatggacgagcttccgcagctgattaatattttaaaaggagatatgagtttcgtcggcccgagaccggaaatgcttgaaaatgtcagggcttatgaagaccagcttccggaatttcgctacagactccgggtgaaagctggccttaccggatatgcccagatttccggaaaatataacacatcaccgaaagacaagctgatgatggatatgatctatattgaggagttcagtatcctgagagatatccaactgattttccagactgcgattgtacttttgaaatctgacagtacagaggcttttcggacgaacgaaacacggaaatatatatttaaagaagcacaagaaacgaaaacggaggaacagtaaaacatgaaaaagtatgattatgtgatcgtaggaggcggattgtttgcgggtacatttgcgtactttgcaaaaaaagcaggaaaatcctgtctggttgtggaaaaaagggagacgctcggcggcaatctttactgtgaagacgtggaaggaatccatgtacacaagtacggcgcccatatttttcatacgagcaacagaaaagtatgggatttcgtgaattctcttgtggagttcaaccgttacacaaactccccggtggcaaattataaaggggaaatctacaatatgccgttcaatatgaataccttcagcaaaatgtgggggattgcgaccccgaaagaggcggaggagatcatcaaccggcagaaggcggctgtcaaaggggaaccgaagaatctggaggaacaggcgatcagtctggtgggagaagatatttacaaaaaacttatcaagggatacacggaaaagcagtggggacgtgactgtaaagatcttccggcttttatcatcaagcgccttccggtacgttatacttatgataacaattactttaatgatctctaccagggtatcccaatcggcggatataatgtgttgatcgatgcactgttcgaaggctgcgatgtggagcttggcgtagattacaatgaaaataaagaaaagtacaacgcgcttggaggaaaagtgctctataccggtatgctggatgcatattttggatatcagtttggcaagctggagtacagaagcctgagatttgagacagaggtgctggatgaacagaatcatcagggggtggcggttgtcaattatacggacagggagacgccatatacccgtgtaattgagcataagcactttgaatttggaacccaggaaaagacagtcatcacgaaagaatatccaacagactgggaagaggggatggagccatattacccggtcaacgatgaaaagaaccaggaattataccagaaatacagaacgttagctgatgaggagcatctcctgatcggcggcaggctggcagaatataaatactacgatatggataaagtgattgagtctgcgttccagcttgtggaaaaagaattgcaataggagaataaaagtatggaagagaataagatcaaagtcagcgtcattatgcctgtctacaaggtagaagaatatgttggaaaggcgattgagagtattcaggctcagacattaaaggactgggaatttctgattgtcgatgacggaactccggataaaagcggggagatctgtgacgcgtatgctgcggaggatgaaagaatccatgtgatccataaggaaaacggcggcgctccaagtgcaagaaataccgcgatcgagatcgcgaaaggagaatacatgtatttcatggattccgacgactgggcggaaccgacgatgctggaagatatgtacaagcttgcaaagcgggacaacgcgcagctcgtggtggcaggtttcttcattgacacctattatgacaaggagcattatgtgacagacgattacgtggtggaggatgctgtttatccggacaaagaatcgttccggagaaacgcatacaaactatttgacaaaaatctactctatacaccttggaataagctctttgagtccagatatattatggaaaacaatctgcgtttccctgagacattctgggatgatttcccgttcaatgtcagcattgtaagaaatgtggaacgagtgaccgtgacccataagcagtactaccacttcctgcgggcacgctccgagtctgagactgcggcttatcgtccgggtatgtatgaaaagcgggaagaagagcatggctggatgatggatctttacaaagagtggcatgttggcgacgcaaagagtaaagagatgatagcaaggagatatgtagagcgtttcatcggctgtgtggaaaatgtcacgaatccgaaatgcgaaatgacaaaccaggaaaaacgtgccgagatcaaaaagatgctggcaaatccgagagtaggtaagatggtgaaagtggcaagaccaagatctttctatatgaaagtgatgcttctgccggttcgttggaagagcacctggcttacctatctggaggcaaaggtgattacctttgtaaagacgaaaaacacgaaactgtttaccaaattaaaggcgggaagataatgagagatcagagaatcagaattttgaatattgccaatatgaattctgacagtggagtggcttgctttctgatgaattacctgcgagccatggacatgaaaaaattccgcatggattttgtgtgctgggacaaaagagaagataattgctatgctgaaattaaaaaaatgggtgggagagtttttcttgttaccagctataaaaaaaatcccatccgttttttggcagagatcaggaaaattgtgaaacagggaggatatgacatcatccatggacacgaggcgattatgagtttgcctgcactgtggtatgggaaaaaatacaaagtaccggtacgaattgcgcatagtcatagtgtgggaatgacgtcgcctgtgaaagagctgattgcgtctgtcagcaggcatgcgtttgaaagatattgcacagatgtgatggcatgttccaagatggcaggggattatctgtttggtgatcaggtatttcaagaaaggggacaggtacttcataatgcgattcggacagaagagtatgctttccaaaccgaggtaagagaaaggctgcgccgggagctgggagcagataaagagctggtaattgggcatgtgggaagatttaatgaaaataagaatcataaattccttgtagacgtctttgaaaaggtattggaaaaggaaaaagatgccttgcttcttttgatcggagagggcgaaacgatggacgatgtgaagaagcaggtcagtgaaaaaggaatggaacgccaggtacgatttttaggaatcaaaaagaatgtaaatgaatggcttcaggcgatggatgtgtttgcctttccttcttttgcggaagggctcggcatcgtattgattgaagcgcaggcggcaggactgccatgctgttgtacagataccattccgggagaagcaaaatgttcggaaaatatggtgtttttatctttgaatgaaaaaaaagatgtgtgggcagaaacattgctcgatatgcgtgttgaggatcgggcggcaggaacacagaatgtcagaaatgcaggatatgatgtgcttgaggaagcaaataagctggagcggttttatgtcaaagcgagtgcgaggtaacaatgaaaaaggtattagtttatggtatgaccaatcttaccgggggaattgaaaactatatttacaatcttaccaaggagttccgaggagtatttcagtttgattttctcatccactttgaatctatggcttttgaaaaagagatgagggaaaacggatctcaaatattttatattccggggaaaggacagggtatcctcacgcatttgagagcgtttttccatttcttgagaaaacatcgggaatatcgggtgatttattttaatgtcatggatccgatggtatttccaacggtgatggcagcgcgtcttatgagaagaaaatgcgtggtgcacagtcataatggcgatatgatgaaaagcaaagtccagaagatatgcagattttttctgaatctagctgtaaatcagcgaatgtcgtgtgcgcaatgcgcttcggaatatttgtttggaaaaaggaaaaggaaacaaactgttgtcatacataataaaattgacacggaaaagtacctttttgatcaggatgtcagagcgagaaaacgaagagagctgggaatagaggatcagtttgtgatttgtcatgttggccggctgacccatcaaaagaatcctaagggagtgattgacatcctggcggaaaccgtaaaaaaagacaaagacgtcattttgctgtctgtaggtaccggagatatgaaagagaaagtcaggcaatatgcaaaagcaaagcatgtgacagagcgcgtccgatttttaggtgtacggcaggatgtaaatgagattatgcaggcatcagacgtgtttattcttccatcattttatgaaggacttccgattgtaggaatcgaggcgcaggcaagtggactgccgtgtctcttttcggactgtgtgacaagagaaaccgatattacgggaaactgccaattcctttccttagatgataaagcacgctgggcggatgaaatcataggatgtagaggaatggaacggaacaatcagggacaacaggtaatgaaacatgggtatgatctgaaacatccgctggacaaaaatatcataagaaaatgcctggacagtaagagggaaaaatcatgcgggaaataacagaattaaaagagcttcaaaaaatagaactggaaatgctgcaagaaatcgacaaaatttgcaggcattaccacatacgatattacctcgctggaggtacgcttcttggagcggtcagacatcagggctttattccatgggatgacgacatcgatatcgctatgccaagggaggactatgaacagtttatcaaaatcatgagccacaaaaagcatcccatctataaactgcttgctattgaatgtaccaagggatatccatatacgtttgcaaaagttgtggataccagaaccagacttgtggaagaaatcgggaaagaccttcatcagatgggagtatttatcgatatttttccgattgacgggatgggaaatcaaaaagagaaagcaatgcagcgtttgatgaagattattcgtttacgcagcagaatctgggaagcagcgctgaaaaaagatgaaattaaaaataaagagagaaatctgaaaaatcaaatgattaaatctgccgccaatggactgataaaaatcatcggtattaaaagatgttatcattatatgatgaagtatgtgaaacaggaaacgttccaggattccaaatggatcgcaagcgcggttggcggcgcgggtatcgagcgcgagttgattgagagaaagtattttgacaatatgattaaaatggaatttgagggaaagcgattttatgcgcctgagggatatgagaagtatctgacaaatttatatggtgattatatgcagatgccgcccaaggaaaaaagagtggcgtcgcacagaggaaaaatatggtggaagtagaaaacaatataccagaaatcagtattatcatgccggtatataattcggaaacatttttatatctggctgtagaaagtgtaaagaggcagaccatgaaagaatgggagctgcttttgatcgacgatggttcatcggatgcgtccgggagattatgtgatgcctatgcgaaagaggatgcaagaattcgtgtgtttcatcaggaaaaccagggaattacgaagacaagaaaccggggaatcaaagaagccaggggcgaattcattacttttattgataatgacgatgaacttgtcgaagatattatggaaaaatcctgctcgtatgcgaaaaaatatagggcagatattgtcaagtttggatatcgtgtagaagaggatttcccgaatggagccaaagaagtccgggataattgtataaaacaacaactgattataacaagagaacaatgtggagaggaatatcagaatatctaccgaagtggatattttaatatgatctggaatggaatctatcgccggactctgtttgaggataaaaagttgatgtttgatgagtctgtgattatgggatacgaagattggatttttaacaatcagatgtatctgataccggaacgacaagtgattatggattatgtgggatatattcattatcagagatatcagcatagtacttcaaagaagtttcatccaaatcagatcgaagcaaatgtaaaggcagcggaggcagagtatcatctcctgcgtagaatgaatcaggagtatgggactacgtttacatgggtattaagagcaacggattatctaatagatattctcttcctttttgaaagaagagggtgtaattatggatatcgggacaagaaaaaggcgttaaaatgggtacgctcccaaaaagtgtttcggatatttcataagaaagagcagttgggaaatttgccgaagcaaaggaaatggatggcggttctttttgacagacagtggtatatgatacttctgatattggcggatctatattataaattcatattgtggaaaaaattgagaaaataaaaaaggagacatctatgattttagaatatttaaaacatttaaaaaggaaatggtatatttttcttttagcggtacttgtgataggaggagcagcctatttcggacagtcttatttatacgcaaaagaaaaaggcggagccggaaaatctatcgaagtagatgtttaccgtctgttaaatattgacgtagcttcactggaaagcacgaagacaggtgaaacgttagattacgatatgagtcttttgtggacaagaagtacattgttgtctgagcttgcggattcttatacagaaaactatgatatggaacaagtctgtcccggatggggaaatatggctctgaagtatcaggtagaatggatccaggaacaattccagctttaccatgtaccgaattccatgatctatgaagtgagattctataaagtgattgcggaatcgaaacaggaagaaatccagcctgttatggaagagatgatgaatgactatatagagaaagcaatggaaagtgtttctttggtagaaaaggatttgaaatatgaagttgccaaagagaagacatatatcaggaatcagatcgtggaggcagagaatacttttaaagtgaaagaatttgctcttgccggagttttgggagttttaggcggattatttgtgatcacgatattatttgtaagaaagaaataaagcacaggagtctttatgatttatatattattttttggattatgttgtatgtttgttacagcatatttgatgaatcaaaaagatatattgtctccctgggtcattacgatcgggatgtttctggtcagtacattttttgcgattctgaacattgacacatggcagtttacgctgagtccgctgactgttttcgtgatcttgaccggagtttttgcatttggcgtgggagaaatattgatttcagctgcttttgaaaaacatgctgttccaaaaagaaagcaaaacagaggaatttcaagaattgaaattccccaaacgatagtgatcgtaattgtacttggtatggtagcaggtttggcagttatgatcaagcagacatatgaaatttcgctgctggcaggaaatacgaatggtctggcttcgatgttggagtatgcaagaaaaatgtatattattccaggatatacgatcggaaaggcaagtattcatatatctctgctaggaaaagcattttcagcggtttttttatatttctttatcaataatctccatgcagggaagaacaggcgggacgttctttatcttttcccagttgtgttatacttatgtatggcagccctgggcacaggacgtacctttatgatcgagtttttaggaatggtcattatttttcatttcctgattgaaagaaaaaagaatggatggaagaccattcatgtatggaaaattgtattgattgcggcggcagcgcttggcgttttctttattctgtttttcctgtttggatttattacaggaaaaagccagggaggaaagttgtttgatatggtttccgtttatacaggaatgtcaataccatctcttgattactggctgaataaagccaaggatctgtcgacggtctttggcgaagagaccttgtatggagtaaccagtgtccttagaaagctgaatctggttcatctaaaggaaacggtgcgtcatttggaatttgtggatttcggagatgcatctggaaatgtatacacatgcctgcgcagatacatcaatgattacgggtatgttggaatgttatttatgcagggagctgtaggtgcattttattccttattttataataatatcaaaaaagagaatggatttggaattttgctgatcttttacggggtgctgatgtatccattatttatgcagagtatcgatgaactgatcctttcttcgtatttatcgacgtcatatatgtatttagcagtttatattttggtaatctattttgttcttatgagagtcagcaaaaagaaagttggaaagttgaatgaactctaaaataaaaaatgtatttcaaaacgtatcctactctgtattggcgaatggaatcaatactcttgtttccatggtcctggtatttattgtaccgaaagctctgggggtaagagagtactcatactggcagctatatactttttatgtcacttataccggcttttttcattttgggtgggcagatggaatctatctgaagtttggcggaaagaaatatgaagagttagataagacatattttaacagacaattttggctgctgacgttttttgaaatcttgattgccttggtaatcggcgcagttgcatatttcggggtagatgattcacagaagcagatcgttctcatcctgacagggacatgctgtattctccagcttccacggacattgcttcagtatattttacagattacagaccgaatcaaagattatgccaaaaattatatgttggaaaaaatcgtgtatgcagtctgtgttttgtccatgctcgcgctgggacaaaagaattttgtgattttgatttcagcagatttatttgcaaggcttgtcactttggtacttctttgtattcaatgtaaagatatggtttttagaaaactatcttgtgtaggaattggagtgagggagtccggagaaaatatagcaataggcagtaaattgatgtttgccaatattgcagggcttttaattaatggaattgtaagatttgccatagagaatcactggaatgtggaaacattcgggaaagtttcccttacaatgacaatgtcgaatatgctgatggtctttatcagtgcagtcagtgttgtcatttatccgatgttgaaacagacaccggaagaacggttggctcagatgtataaaacgattcggatgatgctgatgataccggttcttggaatgttattagtctattatccggccaaggtcttgttgagcggatggcttccccagtatgccgagagcttaaaatatatggcgctcctcttcccgatgtgtgtctatgaaagtaaagtttctttgttaatcaatacctatctgaaagcgctcagaaaagaaaagatgatgatgtatattaattggggaatcgtagtgatttcgtgtatcattacaggagtcgtagtatatgtactggacaatctgacattatcgattgcttcactgacagtcatccttgcgctcagatgcaatatcgcagagatttatcttatcagaaccttaaaaatatcatcagggaagaccttattatttgaaaacggacttgctctcatcttcattgtgtcgagttggatgattcaatcctggttctgcatgttgatttatggagctgcgtatttggcttatcttttttataacaaggagaatctgagaccattgatagaacagatgcgggatggtgttttcagaaagatcaggaggaaatagaatgaacatagcagtaatttttgccggagggatcggaacacgcatgaacagtaaggcgcttccgaagcagtttttgaagctttacgggaaagagatcattatttatacgctggaacattttgaaaagcatccggaaatcgacgcgattgcggtggcgtgtgtggagggatggatcccgtttctgaatgaattgctggaaaaatacagattcaagaaagtgaaaaaggtcgttccaggcggaacgacagggcaggattccatttatcaggggctgaaagcggcagaagctattgcgcatggagagaaaagtattgttctcgtacacgacggcgtacgcccgctgatcaatggagaactcattacaaactgtatccaggctgtcagggataaggggagcgcggtgacgacggctccggtgattgagacgatcatatgctcgggagaagaacggaaagtggatggaatcatagaccggtcaaaatgtctggttgcacgggcaccacagtgtttctggctttcagaattgctggaaagtcacgagaaagcaagaaaagagggacgtttggattatattgattccgcgtcgattatgtcccactatggcaaggagctgtttgtggtggacggcccggtagagaatatcaaaattacgacacccatggatttctatacattccgggctctttttgaggcacgggagaattcgcagctttttggaatctgaaaaaacaggaggaatggcaatggattatcagaatcagatcgtcagagaggatatgtgtgagcttgcaaaggaacacttgccgtttgaaaaactaaaaggaagttcggtccttgttacaggagcatctgggatgctcgccacctatatggtatatttttttatgtatcttaatgagacaagaaagtatgatataaacgtgacagctctggtcagaaatgaaaagaaagcatgggaaaaatttgaggattttcgtgatatgccatatttccatctgaaggtgcaggatgtgtgtacgccgattaccatggaagagaagccggagtacattatccatgcggcaggaaatgccagcccgcattttattttacatgatccggtcggaatcattgccgcaaatacaacagggacggtaaacgtcctggaacttgcaagaaagtccggtacaaaaaaagtgctgtacacttccacacgggaggtatacggaaaaatgccggatggaacagaagaaatccacgaggagacatttggaagtctggacccgatggaatttcgagcctgttatccagaaagtaagcggatggcggaaacaatctgtcagagttactaccaccaatatcaggttccgtttacagccgtgaggatcgctcattcttacggcccgggcatgaccatcaacaatgacggcagggtcatggcggatttcatctcagacatcgtaaataatagagatattgtgttaaagagtacaggcgacgccgagcgggcgttttgttacatcacggatgctgttgcggggatgctgtttgctttactggacggagaagcaggggaggcatacaatattgcaaatgagacggaaccgcttccgatccgtgaggttgccgggatgttgaccggtctgttcccggaaaggggaagaaaagtcgtatttgatattccggaaacgatgagtgccggttacagtaaaatgggacgcacaagactgaatacggagaaactggagaaaatgggatggacatgtaaagtgccgttaaaagaaggattaaaacgaaccgtgaaaagttttgaataattgcagagaaaacgggactaccctcattgtattcatgggaagtcccgtatttttgtaatgttagcttcggattttaacatatgggaaagtttgctctcacttgttttccagaaatccgcggatcacctgctggtcattggcactgcaatttcggtacttttcgatcaattccagctcctgatctgtcagaaagatcgaacgcttgtgatcttcggtctctcccaggtggtagttgtaaatcggcagggactcgttgatctgatccacatgaatgatcccggcgaccaaatcatccaaggtgaccttataaaaatgagaaaaacggactaacgtacacaagtctggctctctgagcgctttttcatagtgagagtatgcctgtctggtgatatttaaaatagcactcagatctttttgagtgtaattatattttaagcgaagcgtctttaaattccgtgcaagctgtacatttgccatggcatacctccatttttagaaacagtatagcagtttcttatgtaaaattcagataatgccacgaaacgtataatatatacaaaaagcaacgaaacgttgtcatttattattttataaatccctatttcagatactgagtctgcttaagacgctgttatgatactgctttgagaatgtcacgtcttccccaaaccaggaaggcggcgtataagtatctgctttttccacggaaggaaattcaatttctgccagcatcagcggagcgagatctccatggaaacagtccagttccgccgtcagtccgtcctctaaagggatcagatagcgccgtttttggatcagtcttccatctatttttgtacgcagatgttcataggcttcttttgtgagaggaagattatactcctcccggaccaggaaccctttggatttgtaggtcagcacatagctgtcatcgtaacgccggatgcggacaaccggctctgtgttcagatatccctgttcaatctcatgggatggatagtcatgcagtgagaaagggcaggtctcgaccagatattttcgctcgatttccatattgtcattattcattatcatttcctcctggagtttgtattcctgtttctttcagtataaagagatccaaagaggaaaacaagcccccctaaatagtattttccgacaagttgtaatgattcggccatccggctcagagctgcggtttgcggcagattttcgttgcccaggccgcatggctgaatcgttatgccaggttgcattttgcaggtgagtctgctagaatcagaccgtataaggaggaaaacaccatgagaaaaatggcatatacttttgcggccatactgcttgctgccgtgtttggtcttacaggctgcggcggagactttgacgcggcaggttatatgcaggccgtgctggatgagagactccagggggaattttcggaggcggcgcagatcatggacacatcggaatttgagctgaaacaggattatgaatcatcggtggacagctttgtttatgcctatctgacggccggatacgaggagctgaatgattacacgctttatgagtacgagacacttgtaaaagatatcttcagtgtgatgaaatacgacgttaagaaagcagaaaaggccggggaaaaggaatatgaagtttccgttgagatacagccggtggatttgttccttaattatgtaaaggagcttgagcaggcttctgatgaaatcgagaagtcagcaaaaaacggcggatacgagggaaccgaagaagaaattcgggaaatgatgcagtacgattatctgtccagggcgtacagccttttacaggacgcctatacctcgatgcaatacggaaaaccggaaaccgtgatcgtggaagtcgcggcggaagatgggaattcttatgccgtcagcgaggaggagtaccagatgcttctggagcagttcttccggatggatgagatcgcgaacacgaactaaggacaaaagcaaaagacgaaaatcactggaaaaagtgcaggatagggctggaaatccatattagaatatggtatactcaaacaatcagtgtaatgtagataagtctgccgacttttcgcatatacgataatatttaggaggaaatgtaaatgagtttacaagtagagaaactggaacacaacatggcgaaactgacgatcgaagtttcagccgaagaactggagaaggcactccagggagcttataataagcagaagaaaaatatcagcatcccaggattccgtaaaggaaaagtgccgcgccagatgatcgaaaaaatgtacggaccggaagttttctacgatgacgctgcaaatcagctcattccggaagcatacggaaaagtatatgatgaagaggatcttgagatcgtatcgcagccaaagattgatatcgtacagattgaaaaaggcaaaccatttatttttacagctgaggtggcattaaagccggaagtaacattaggcgaatacaaaggattaaaggtagagaagatttccaaccgtgttacacagaaggagatcgacgcgaagcttgccgaggagcaggagaagaacgcgagaactgtttctgtgacagaccgtccggttcaggataaagatgaagtcgttcttgattttgaaggatttgtagacggcgtagcattcgaaggcggaaagggagagaactatccgcttactataggttccggatcttttattccgggatttgaggatcagcttatcggtgcgaatctggaagaggaaaaagaagtccgtgtaacattcccggaagagtaccatgcaaaggatctggcaggaaaagacgcggtattcaaatgcacagtacatgagatcaaagtaaaagaacttccggagcttgacgacgagtttgcttccgatgtatctgagttcgagacgctcgatgctttcaaagcagatatcaaggcaaaaattaaagaacagaagatcgcggaaggcaagagaaaacaggaagataaagcagtggaagaagctgtggcaaacgcacagatggatatcccggatgccatgatcgataccgaagtaagacagatggcaaatgatttcgcacagagattacagcagcagggccttacgatggatcagtacttccagtttacaggaatgacagcggagaagatgacggaagagctgaaaccgcaggcattaaagagaattcagacaaggctcgttctggaagcaatcgtaaaggctgagaatattgagatcagcgatgagaagatcgacgaagagatccagaagatggctgagtcttacaagatggaagcagagaagctcaaagaattcatgggagaaaatgagaaaaaacagatgaaactggatatggctgtccaggaagctgtgacattccttgttgaaaacgcggtagaagaataagagacaaaaataaggaggcatattgcatgagtttagtaccttatgtcattgagcagacaagccgtggagagcgttcatacgacatctactcaagacttttaaaagacagaatcatttttctggacggcgaagtcaacgatgcttcggcaagcgtgattgtcgcgcagcttctgtttctggaagccgaagatccgggaaaagacatcaacttgtacatcaacagtccgggtggttctgtgacggcaggtctggcaatttatgatacgatgcagtacatcaagtgtgatgtgtctacgatctgtattggtatggccgcaagtatgggatctttcctgttatccggcggtaagaagggcaagcgtcttgcgcttccgaatgcggagattatgattcaccagccgtcaggcggagcacagggacaggcgtccgagatacagattgcagcagaacatattctgaaaacacgccggaaattaaatgagattctggcagcaaacaccggacagacgcttgagacgatcgcacgggatacagatcgcgataatttcatgtctgccgaggaagcaaaggcatacggtttaattgacgaggtcattacaagccgataaagggaaacaaggggctgtcccagtggcctgggacatcccctttccgtgtttcaaaacgatacggaaaatataaaatagtaacgattcagctatatgccgggaaatatcgaaagacttctgcagccaagcctgcattttggtaatccaggccgcatggctgaagcgttacataaaatgaggtgtgagaatggctttaaaagaagatgtagtgagatgttccttctgtaataagccacagtctcaggtgcgcaagctgattgcggggccaaacggagcatatatctgtgacgaatgtattgagatctgtgccgagattatagaagaagaatttgattatgaagacgaaaataacgggccgggagagattaatctcctgaagccggaagagataaagagctttctggatgattatgtggttgggcaggaggaggccaaaaaggttctttccgttgcggtctataatcattacaagcggatcaaagcacagcgagatcttggggtggagctgcaaaagagcaatattctgatgcttggaccgaccggaagcgggaaaacgcttctggcacagacactggcgaaggtgctcaatgttccatttgcgattgcggacgccacgactctgactgaagccggatatgtcggggaagatgtggaaaatattcttcttaaaattattcaggcggcggatggagatattgagagagcagagtatgggattatctatatcgatgagatcgataagatcacacggaagtctgaaaatccatccatcacccgggatgtctccggggagggtgttcagcaggcgcttctgaagattgtggagggtacgattgcatccgtacctccgcagggcggaagaaagcatccgcatcaggagctttaccagatcgatacatccaatatcctgttcatctgcggcggagcatttgaagggatcgacaagattatcgagaaacggattgatcagaaatccatcggatttaatgcggagattgcggaaaaccacgaggacaatctggacagactgttaaaccaggtgcttccgcaggatctggtgaaatttggactgattccggagtttgtcggtcgtgttccggttgtggtagcactggagtccctgaaccgtgatgcgttgattcagattctgacagagccaaagagttcgattgtcaagcagtatcagaagctgatggagctggacggcgtcagactgcattttgataaagacgcgctggaggctatcgcggatcgttccattgctagaaatacaggagccaggggcttacgggccatcatggaaaatgtgatgatggatatcatgtaccgtgcgccatctgacgagacgctaaagacctgtatcattaccagagatgttgtagaaggaaagagcctgccaaagacagaacatgaagagcgggaatccgagagtgcatagcagacagaaagtgcataatagacagaaatgggaaaggtgcaggtatgttttacctgcaccttttgtaaaatacggaggacataatgacagaacagatcaatcatataccagttgtaccgcttaggggactgaccgtttttccgggaatggcagtacattttgacgtgatcaggatgaaatctatcgaggggattcagcaggcgatgcttgcagggcagaaggtatttctgatccgacaaaaagatgagaaagttgaggagccggataaggacgcactctgccacggaggagtacttgccgagatcaggcaggttgtccgtgtcccgcagaaaggcatccgggtcatggtttatggagagaagagggcaattttgcgggagtttcgggaagcaaatggattctgggaaggtgatatttccatttatccggagaagtgcccggatcttccagaaggcgtgacactggaaggaatgaaaaaggtactgacggatgccttgaagcagtatgcaatacgcacaaagcgggtcccggaaggagtcattcaggatatcttaaagatcgacgacgtctataccatggcggcagaggccgctgcgggcatcggcctggattcagcctctcttcagaagcttctggatgaggatagtctcctggagcgattctatcttctggcggctaagattgaggaggagacaagagcctttgacatcacagcagagatcgagaaaaaagtccgggaacggattgacagaggacagcgggaatatatcttgcgtgaacagttaaaatatatccgagaggagcttggtgaggacggtactacatccgatgccgaagaatttgaaaaggcagagcaaaagcttctggctcctgaggaagtgcatgagaagatcaaaaaggagatccgacgctttaaacaggcggtgaacaatccgacagaggccggtgtgagccgtacctatattgaaaccatgctggagatgccgtgggataagcgggcagaagagtttacggatatcgcccatgccaaggagattctggaggcgcagcattatgggctgaaggaagtgaaggagcgggtgctggaatatctgtcggtgcgtgcgctgacaaaccggagcggttctcaaatcctctgtctggtaggcccgccggggaccgggaagacgtctattgccagatctctggcagagtctatgaaaaagccgtatgtgagaatttctcttggcggtgtccgggacgaggctgagatccggggacaccggaagacctatgtaggggccatgccgggacggattgcggacggacttcgcaaggcgggagtgaaaaacccggtgatgctgctcgatgagattgacaaggtcagcaccgattataataaaggggatacattttctgccctgcttgaggtgctggattccgaacagaacaggaagtttcgggatcattatctggaggtgccgctggatctgtccgaggtggtatttgtgacgacggcaaatactctgcagacgattccacggccacttctggaccggatggagctgatcgaggtatccagttatacggaaaatgaaaagatgcacattgcaaaggagcaccttttgaaaaagcagttggagcgtcacggactggacggcggacttcttctcatttcggacggggcgctgtggaagatcatccgcggctacacaaaagaggccggagtgcgtacactggagcgaaggatcggagagctttgccgcaaggcagccagagagatcctggaatctggaaaaaatcaggtgcggatcacagaacgcaatctgacacattatctcgggaaagaaaaataccgttatcatcttgccggaagccgggatgaagtgggaattgtaaccggacttgcatggacaagcgtgggaggggatacacttcagattgaggtcaatgtcctttccggaaaaggaaagcttctgctgaccggacagatgggggatgtgatgaaagagtccgcacaggcgggtatcagctatattcgttctattagtgggcggtacgggattccagaggacttttttgaaacgcacgacattcacgttcatattccggaaggagcggtgccgaaagacggaccgtctgccgggattacgatggcgacagccattctttcagcagtgaccggacagaaagtccgctccgatgtagccatgaccggggagattacacttcggggaagagtacttccgatcggcggtctgaaagagaagctgcttgccgcaaagaatgcgggaattcacctcgtgctcgtgccggcggaaaatcagacggatgtagaggaactttccaaagagatcacgaaagggctggaagtgcgttttgtttccagaatggaagaagtattacatactgctatgtcagagcaggtggaacaaaggagggaacaggatggtaattaaagaagtgacgctggaaactgtctgtgggattacgagtacacttccagaaaatgataagccggaaattgcgtttgcggggaaatcaaacgtaggaaaatcttcgctgatcaatgcgctgatgaaccggaaatcccttgcccggatttccgcgacgccgggaaagacccagacgatcaacttttacaatatcaaccgggaaatatatctggtggatcttccgggttatggatacgccaaggtttcggagaaggaaaaagaggcatgggggaagatgatcgagcgctaccttcataaatcgaccatgctcaaggcggtctttcttctgattgatatccggcatgatccttctaaaaacgataaaatgatgtacgactggattttgcatcagggctatgaaccagtgattatcgccaccaagcttgataagctgaaaaaaagccaggtggcaaagcagttaaaagcgatccggacaggacttggactggtaagcggaactacagtgattcctttttccgccaagacaaagcagggtagagacgagatctgggagtatgccgaatccagactgtttgaatccgtcgacaaggaggaataagatgggagaagacgcagacagaacgaaacaagatacaagaccatactggaaggtgacggcaagtctctttttcagcctgcttgggacggcgctttttcttgtgatcggaatccgtgcactcggctttttcatgccttttgtgatcggctggtttatcgcttacctggcgcatccgcttgtagggtggctggaaaaccgggtaaagatcaagaaaaaattcggatcagccttgatcattatactcgtaatcgccattgtggccggacttggctatctgggaattgtgaaactcattcgtgaggttcagatggctctcaacaatgcgcctcatctttaccgggatctggaatccgggttaaaagagatcggaggacggttccaggggttctataatatgctgccggacaatattcaggatggctggaattccctggtgcagaatatggacgaaaaagtcggagggctgattgcgggtctcgggaatccggctgttgagatgaccggaaacgtggtgaaacgaattccaagcgcgcttgtgtctgtgattgtcgcacttgtgtccgcatatttttttaccgctcagagagaggaggtcatccagtggagcaagaaggtggcgccaaaggccatcgaagcccggatgaccatggtcatttacaatctgaagtatgcggtgggcgggtatttcaaagctcagtttaagatcatggtaatcgtgggactgattctgctgtgtggatttctcattttgggtgtggattacgctttcctgctggcactgttgattgcgtttctggactttctcccgttttttggaaccggaacagcactgattccgtgggcagtctataaattctttgtgacggatatcaaaacggcggtggggctgcttgtgatctacggcattacccagcttgtgcggcaggtgatccagccgaaactggttggtgacagcatcggactgagccctcttgtcacgctggttttattgtatgtgggttaccggattggaagtattttcggaatgattctggcggtgccggttggaatgattgtattcaatttgtacaaagcaggagcttttgactatattctggatgatgtaagaatcctggcgcggggaatagcgtccttgcgggaaccatagtatctgggaaatatgaagtttcggacggcggattttcaatacaactttgaggagctgctgtcctttttttcggcatttggctgaaattgtgcagtatacacaggttggattgccggtcaacagggaggatgatataatagtaccaaaatgcgggtttcaaaaaggaggaatagcatatggcacttgatgttcagaatacaaaaaagatgatcgaagaagggagggcggttctggggattgaattcggctctacaaggattaaggcggttctgatcaatgagcaaaacgagccggtggcttccggaagccatgactgggagaatcggctggacaacggtatctggacttatacacaggaggatatctggacggggttgcgggaaagttatcagactatggcgtatgatgtggaggaaagatacggggttcggatcagacggctgaaagctctgggattcagtggaatgatgcatgggtacatggcatttgacaagaatggagagctgttggtgccgtttcgtacctggagaaatacgatcactgaggaggcatcagaaaaactgacggaacttttccagtaccacattcctcagagatggagtattgcccatctgtatcaggcgatcttaaatgaggaagagcacgtcaaagatgtggcgttttttacgacccttgcaggatatattcactggaaaataagcggaaggaaggtgcttggtgttggagaagcctccggcatgtttccaattgatattcaaaagaagcagtttaaccaggagatgatgaaacagtttgacgcacagattgagggaaaggggtatccgtggaagctggcagagatccttccggaggttttggtggcaggagaagacgcaggtgtgctgacagaggagggggcaaagcttctcgatccttccggagcgcttcaggcaggtgcgtcgctttgcccgccggaaggagatgcaggtaccggaatggcagcgacgaacagtgtggcgccaagaaccggcaatgtatcggcaggaacgtctgtgttcgcgatggttgtgctggagcaggagctttccaaagtttatccggagatcgacattgtgacaacgccgtccggagatctggtgggaatggtacactgcaacaactgtacttccgatctgaatgcctgggtatccctgttccgggaattcggggaaacgtttggtatgaagatcgatctgaatgatctgtatggaacactgtatcggaaagcgctggaaggagacgaggactgcggagggcttttggcatataattatttctcaggggaacatattaccaattttgaagagggtcgtccgctttttgtaaggactccaaagagcaaattcagtcttgcgaatttcatgcgggtacacctgtatacttctcttggggcgttgaaagtcggaatggatattatgctgaagcaggagcatgtgaagctggataggattctgggtcacggaggactcttcaaaacaaaaggcgtaggacaaagcattcttgcgggagcaatcgacacgccggtgtctgtgatggagactgcgggagaaggaggagcttgggggattgctcttctggcgtcttacctcgtacacaaagaagagggagaaagtctgccaaaattcctttccgcaaaggtatttgcgggtgagactggaactgtgatgggagcggatccaaaggaggtagccggatttgatacttttatcgagcgatataaagaaggatttgccatcgagcgggcagcagtagaccatttgaaataggcgtgttatactagctgtaaaaagaaagaaggatcaacatgccaaaagtacaaatgacaacacttggatatattgagacgagggaatcctatcttatgcttcacagagtgaaaaaagagcaggacgtcaacgagggtaaatggatcggaatcggaggaaagtttgagtatggagaaagcccggaagaatgtatgatccgggaagccaaggaagagacggggcttgccgtcacctctatgaagttccgggggattctcacattcatctgtgataaacaggacccggaatatatctgcctgtatacgattgacggtttttccggacagctcaaagaatgtgatgaaggagagcttctttgggtgccgaaagatgaaatatttgggctgaatctatgggaaggagacaggatttttttcgatctgcttcagaaggatgttccctttttctctctgaaactttgctacgaaggcgatcagcttctggaagctgttttaaatggagaaaaagagcttgtgagaacagcgaaagtgtgatatagttagaaaaactgaataaaagccttgatttcaaggaagaagatagaggcgcgggattcatcagtatgctctggacagacggacgtaccatccgcagagcagaaaggggaaaccgccgaaggaagtgaaggaggacgtaactttgctttctgggatgttgtagaagatacagcatactgtcacagattgtggagcgctatcgtggaatcggaacagatatctgagccgtgagtgtgttttgcatatactcacggctttttgtattggcgacgaaccaaagtccgggcctgcccgagaccttggcgaccgcttacaatcccggaatgtgtcttttggcacttccggtgattgtattggctgcagcgaaagaaagaaaaaagggagagagaaacatgaagcaaaagaaaacgatacgaaaagggctggtggccgtgcttatgattgtatccatgtggtcactgacagtgtttgcctcagatggagagacggtacagcctgcgatgtatgcaaccttctgggcgctggtgccgccgattgtggctatcggccttgcgttaattacgaaagaggtgtacagttccctctttatcggaatcgtggtgggaggtctgttcgcctccaatttccactttgaaggcactgtcaattccgtgttaaatgaaggaatgatcagcgtactgacaagttcggacaatgtaggaatcattatttttctggtcgtattaggcgttatcgtcagcatgatgaacaaggcggggggatccgctgctttcggggagtgggccggaaaaaggatccgtacaagagtcggggcacagcttgcgacgattgcccttggggttctgattttcattgatgattatttcaactgtctgactgtgggaagcgttatgaggccggtgacagaccgccataaggtgtccagagctaagcttgcctatttgattgatgcgacggcggctccggtgtgtatcattgcgccgatttcctcttgggctgctgcggtatcgagctatgtggaaggtgaagacggattttcgatctttatcaaggcgatcccgtacaatttttacgcacttctgactattgtgatgatggtaggacttacagtgatgaagatagaattcggctccatgcgtgtccatgagaagaacgccatcaaaggcgacctgtacacgacgccggaccgtccgtttgccaatatggaaaataaaagcataaaagaaacaaaaggaaaagtcattgacctcgtgattccggtactcatccttgtagtatgctgtgtcatcggtatgatttacaccggaggatttttcaacggtactgattttattactgctttttcccagtgttcggcctcggaagggctggcaatcggcagctttttcggacttttggcgacgatgattctttattctgccagacgtgttttgagctttaaagagtgtatggactgtgtaccggaaggctttcaggcaatggtaccggcaattctgattcttacatttgcatggaccttaaagacaatgacagatcatctgggagcggcggattttgtggcaaatgccatgtcatcatccgcagacggtctgatgaacctgctgccggcgatcatcttccttgtaggatgtttcctggcgtttgcgacaggaacaagctggggaacctttggaatccttatcccgattgtcgtggcagtatttgagaattccaatccggagctgatgatcatttccatttctgcctgcatggcaggagcggtatgcggcgatcattgttccccgatctccgacacgacgatcatgtcgtccgcaggggcacagtgcaaccatgtaaaccacgtatctacccagcttccgtacgccatgacggcggcagcggtcagcttcgttacctacattatcgcaggatttacacagaccgcatggatatcactgccgattggtatagtcctgatgcttgctgttcttcttatcatccgaaaacggcacggcgcaaaagacatggcagagtcataggtataacgtattggggagggattccgatatatcggaatccctcccctttgtaaaatctgtactataaattttcggatttttacaatacaacttttcaatttcatataaattgtttgaaacaaatttggataattctccggcttgtattgtgcatgtggatagggtatagtgataccagaatgaaagagaggctttgacatgcagaagaagtatgaagaggtgattgcctggatccggggagagctgcgtgaagggcggctgaagcaaggggacaaacttccttcggagaatatgctaaagaagcggttccatgtgagccgtcagacggttcgcaaggcactgtctgtactggaggaagagcagattacacggagtgtgcgtggcagcggaacgtatattgagatcgggaaacggcagcggaaacgttcgatgcggattgcggtgatgacaacgtatgcggacgtctatattttccctttgattgtgaaggaaatcgggagggtgctttcagacgaaggatttcttcttcagattgccgtatccaacaatgcgatcgaaaaggagaggatgatcctgaaggatttcatccgtgagaagtcgattgacggactgattgcagaaacgacaaagagtggaatcccaaacccgaatctgaagctctataaagagctggaacgaatgggcgttccgattctgtttatcaatagcttttatccggaactggatatccctcacattagtctggatgaccgggaagcggggcgtatggtgacgcagcatcttctggactgtggtcatatgaatatcgccgggatttttaaaggtgatgacggtcagggacaccagcgttatgcgggatatgtggacgcgttgatggaggcggatatcaaggtgaaaggaaaacaggtgatttggatcgattcagatgagattgaagagatgcgggatgattgcggccgggtcttgaaacgaatcaagggctgcacagcctgtgtctgttacaatgacgaggtagccaacaagatggttggaatctgtatggatcagggaatccggatcccggaggatctctctattataggaattgatgattcggatttgtcacgattctgcgaaataccgtttacttctgccagaaatccggtgcgagagctggggagaatcgccgctgagatgatgataggacggattcggggatttacggagatcgagacagtagagcttgagccagagctgatcatgcgaagttcggtcaaggtcatcaatcatatttgacgtaagcggcaggaaccagccgcagccgggaaaaaaagaaagtaaaaagaaatgaataaaaagcaggaggacaaacaaatgttaaaacagaaaacgtaccaattttggttctgcacaggatcccaggatctctatggagacgcatgtcttgcccatgtagcagagcacgcacagaaaattgtggaggcgctgaattcatccggtgtacttccgtatgagattatctggaaaccgacattgatcacaaatgagctgatccgccggacgttcaatgaggctaatacagatgagacctgcgccggcgtcattacctggatgcatacgttttctccggcaaaatcctggattctcggactgcaggagtacagaaaaccattgctgcacctgcacactcagtttaatcaggaaataccatacgacaccattgatatggactttatgaacgagaaccagtctgcacacggtggccgtgaattcggacatatcttcacgaggatgggaattgagagaaaaatcgtggtgggacattggtctgatcagaaggtacaggaaaagatcgcatcctggatgcgtacggcagtgggcgtcattgagagcagtcatgtccgcgttatgagagtggcggataatatgagaaatgtggccgttacagacggcgacaaggtggaagcacagatcaggttcggatgggaagtagacgcttatccggtcaatgagattgcccaagcagtagaagacgtcaaagagggagaagtcaatgctcttgttgacgaatactatgataaatatgatattcttctggaagggagagatcctgaagaatttaaaaagcatgtggcagtacaggcgcggatggagattggttttgaacggtttttggaggagaaaaattaccaggccattgttacacacttcggcgatttgggcagcctgaaacagctccctggtcttgcaatccaaagactcatggaaaaaggatatggtttcggagcggaaggagactggaagacggctgcgatgctccggattatgaagattatgacagagggaatgaaggatgcaaagggtacttcttttatggaagactatacatacaatcttgttccgggcaaagagggtattttgcaggctcatatgctggaagtctgtccgactatttcagacggtccgatcagcatgaaagtacagccccttagcatgggagacagagaagatccggcgcgccttgtttttacggcaaaggaaggtccggcgattgcaacttcactaattgatctgggcaaccggttccgtctgattatcaacagtgtcaactgcaaaaagacagaaaagcagatgccgaaacttccggttgcgactgcattctggacgccggagccaaatcttcagaccggagcggaagcatggattctctgcggaggcgcacatcacaccgccttttcctacgacatcacagcagagcagatgggggactgggctgacgctatgggcattgaagcggtttacattgacaaggatacagatatccgcacactgaaaaatgagctcagatggaattccgttgcttatcggaaataagaaagagaagaaatcagaaaccatccagaagcattacaaagaaaatcgtaacgattcggacaccctttgtaatgcttcttttcatgtggggaatttaggtgtaaaatagagaacagaaatatgcagagaaaggaagccccgggagggcattgggtgatgatatgaaaaaagaaaatttcggacaaactgccaaaggagaacaggccagtctctatacgatggaaaacgcggcaggaatggaactaaagcttacagattatggtgcttcacttgtcagtctgaaagtgaaagaccgaaccggagaaaagagggatgtagtccttggatatgacgatgtggaagggtatgaaaacggggcaatttttcttggcgcaaccgtgggaagaaatgcgaaccggattagaggagctgcttttgaacttggtggaaagaagtatacgcttgacgcaaatgaaaatggaaataacctgcatagcggctatgatttctataacaagagactttgggaagtgaagcagtcagatacgaagagcattacgttcgctgtgtttagcccggacggagatcagggatatccgggggatgtaagaatcgaggtttcctatactttgacggacgagaatgaagtgaggatttcctaccgggggatcccatcggaggatacgatactgaatctgacaaaccacagctattttaatctgaacggggaggggggagatccggttttaaaccaccaggtgtgtctacatgcggatgcttttacagagacggatgagatgctgatcccgaccggaaggctcattgacgttacaggtactccgatggatttccgtaagaaaaaagcgattgggcaggacatcaaagcggactacgagccgctgaagcttggcggaggatatgatcacaactgggatcttggaaacagcggaagtctgatcaaggcagcggaagtaagctctccggacactggcatttccatggaagtgtatactgaccttccgggaatccagatgtacacaggaaacgggattgaacacgagacaggaaaaggacagaagatctacggcaaacacgccgctgtctgtctggagacccagtacttcccggacgcggttcaccatgaacagtttgaggctccgatccgcaaagccggagagacttatcagacgacaaccgtatataaattcaatgtcgatgaataaaaagccgctttccttgcaatttgaaaaaaatgtgctataataatggacagctagcgaggtaagacaaaatagaatgacaacaggtcacagttttcattaggaggatttattatggcaagaaaacgtacattggcaaaagtagctgcaaagacggaagcagttgccgcggagaccgcaaaggcagcagcagagaagacagaagctgtaaaagaagtcgtagcggaaaagacggaagctgtaaaagaagttgtggcagagaagacagacgcggttaaggacgcggtgaaagaagcgacagaaaagacagtcaaaacggcaaaaaagacaactgcaaagaaaccagcgaaaaaagagatcaaagtacggacattcgttcagtattatggaaaagaagtagaggaaaaagagatgattgccgcagtcaagaaagactggacaaaggtaaacggaaagaaagtgggagatatcaaagatatcacactttatgtaaagccggaggaagcagcagtttattatgtggttaacggaactgattccggaaaagttgcattttaatacaagaaaagtatggaagagataccatacagtcccagagacagtatggtatctttttatattggtgatgaatataaatcgactgataatttatacaaagcattataaaatatagagaaaaaataaaaaatactaaaaaatatattgacaaaataaactgcacgtgctactatcaagacaagataaacgaaaagaaatcaagggatttcagaaaaggaggtacagaccaccgaaaagagaagaacagttcacataatctgagaaaaggtaggttaacgaatgactgaagaaccaacaaattaaggatggacgttgatgataagagcagcatcggcgtccatctttcgtgttgcgggaagatcagttttgtattaaaataaaggcaggaagaaaaagaactaatgagtaattagatacaaaggagagacaaagatggaaagaatatttgaagcagcagatcagaccagccgtctgctttttgaggatggtctgaaaaatatggatttttcatggatcttttcgaagggaggaacggcagcctttgtggtgacaggtgtgattgcgcttctgatgattttgtttggcgccaagtgtaaatatgtactgtttgcgatacagggatttctgcttggtgtgacagccggccttacggcttcctggttcctgcatctggaaggctgggtgatgatcggtgtatccgcaggggccggactggtgtttgccgcatttgaagcggtatttaggaagtttggtgcatttgtattttctttgatcgcagtttttgtaagtgtggctgcgctgggcggcggagaaggttatctggtacttggaatcgcaggcggcgtggcgctcatatttgcgattctcgcggctgtattcggagatcctctgatcattccggtgatgggaatcagcggaggcgtacttgggggaattgtcgcttaccattatctgccatatgagagcaggattgtattttatgcggtaagcgccgtacttgcggttgtcggaatctgtatccagtatgccatgaagtccagtaagatcgcgagactggagcgaaagaaggcaaaagagattcgggaaaagaaatcggtggagtctgaaattgagatggcgagaaacgttttggattccgatgaacaggaagagtcggacaactagaagaaagagagaaaacagaatacgcaaatgaaaaaaatgccgatgagcttgttggtattttgaaaaaaagggtataataagcctggaagcaaaagggggcttgtatatgaagctggacatgcattgtcatgtaaaagaggggtctattgacagcaaagtaggactggaagagtatattgataagctgattgatcatggatatgacgggatggttgtaacagaccacgacacgtacaatggttatcggtattggaagaacgaactgaaagggaagaaataccaggactttatcgtgtttaaagggatcgagtacgatacgagagatgcgggacattttcttgttatcatgccggaggggcgcaagatgcgtctcctggaaatgaggggacttccgcttgcgatgttgattgatcttgtacacaaaaacgggggtgtgcttgggcctgctcatccatgcggtgagaaatatttaagctttaccaatacaaagcgtttctataaatccccggagctgatcaagcgatttgattttatcgaagtatttaatgcgtgtgaatcggaggagagcaacgagggtgcggcaaaacttgcgaaaaaataccataagccaggaatcggagggagtgacgcacataagatcgagtgtgtgagcacggcttatacagagttttcaggaacagcagcctgcgagacagaactcattaatctgatccgtaagaatcagattgtaaaagccggaggaagattctatgacaagactgtaaaagacaagatcggaaaggccaataagcttcttgcctacagcttctggttttacaataagggcggagagctcttaaagcgccggagccggcagaaaaagatgaaagtagaaagtccggtggatccgatcgatccgatcgagatcccgtacctccgggaagctaaaaaggaaaagatgcagaagttaaaagactagttggaaaggagaaggaatggagtacgaaagattagtaaggcggcagaaagagttttttaagatggggaagacaaagaaaccaggatttcggatattttaccttagaaaacttctgaaatggatggaggaaaacgaggacagaattctgagagcgctgagtcaggatcttgggaaatccagtacggaaggatatatgactgagatcggaatggtaaaagaggagatccgttttaacatgaagcatctgacgttttgggcaaagcctaaaagagtcaaaactccggcaacgcagtttccatctttctcatttatttacagagagccttatggtgtcgtattgattatggctccttggaattatcctttccagcttaccgtggccccgctgatcggggcaatcagcgccgggaactgtgcggtgctgaagccgtcttcctattcagtacatacatcggctatgattcaggagatgatccgggaagtattcccatccggctatgtgacggtagtgacagggggacgggaagaaaacgaggcgcttctgagtgaaaaatttgattatattttctttacgggaagtccgaaagccggcaagtccgtgatggaaaaagcagccagacatctcacaccggtcattctcgagcttggcggaaaaagtccgtgtattgtggatgagactgcggatttgaagactgcggccagaaggattgtctggggtaagtttttaaatgcgggacagacctgcgtggcaccagattatgtccttgtacagcacagtgtcaagaaaaagctgatccactacatcgaaaagcagatccagaagatgtatggatttgctccgcttgataatgaggagtattcttccatcattaaccagagacatttcaaacggatctgtgggctgatggacgagcggaaggttatttacggagggcggacagacagtatgacgctgaagatcgagccgaccgtgatggatagcgtcacctgggatgatgccgtgatgaaagaagagatcttcggaccgattcttccgattatgtcgtattacgatctgaaagaggcagtctctgctatcgacgcacagtcgagaccgttggctttgtatctgttcacgaaagacaagaaaagggagtctttcattttaagagagttctcttatggagggggatgtatcaatgatactgtcgttcctctcgcgacgccatacttgctgtttggtggagcgggacagcccggaatgcgaaagtatcacggaaaagcaagctttgatacgtttacccatgagaagagcattatcaggaaatcacttcttgaggatccccctctttggtatccgccattttgggattatctgaaaacaagaaagaaattaatgtaaaaagaaaccgtagcagaacgtccacagaaaaatgagaagtcggctacggtttcgttagttcttaaatgttcccgatggacaggagaatcctgctaaacaggattcttttttatatgggctttgttaaaacatcattccgatccgatagaagatcacagcgaaaatccaggcaatgacgagctgaaaacacgcaaatgcaacagtaatgcttgtctttcctacttcccggtgaatcgttccaagcgtcgccatgcatggaacatagaggaggcaaaagaccatcagcgcataagcgttcgccgctccgaatcccatggagccaaggacggccaccatgctgtccattcccgacggagtcgtgatattggcaatgccaaagaggacactgcagcttgagaccaccacctctttggcggcgataccggagatgagcgccacggcaatctgccagtagccaagccctgccggagcaagaaccggaacgagagcctttccgatgatggagccaaagctctcggaaatatccgatacaaatccatgcgggccgagattcatcacagcccacataatgatggaggcgatgaagatgaccgtacctgctttggagagataatctttcactttttcccacacatagatggcaatcgtgtgtgcgtttggtgttttgtactccggaagttcaatgagcagggcatgttctgccttactgccatcgaaccgggagacgataaaggctgccgcgatggcgattacaatacccagcagatacatggagtaacagaccagcatcctgtattttccgaaaaacatggaagaaaacaggacgtagatcggaagtctcgcactacatgacataaacggggtgacgagaatcgtttttaagcggtccttacggtgctccagagcccgtgatgccatgacagcaggaacagagcagccaaaaccaagaaggagcgggatgaaagcacgtccggaaagtccaagatggctcatcagatcatccatgatataggctacacgtgacatatatccgctgtcctccagaaaggccagcgccagaaagaggataaaaatattcggaaggaaagtcaggatgcctccgaccccggaaataataccgtccacgatcaaggagcggatcagcgggttcgcatggagagcttccaggccgtttgacaccagatccgagaaccagacaagaccaagttcaaagtatcccttcatccagtcacccactgtaaaagttataaaaaatacaaaagccataatgaagaggaagatcggaaggccgaggaaacggctcgtcataatgcggtctacccgctcggtccgctctgctttctggcttttattgacgagtacctcctgaatgatctcctcgataaaatcatatttctggttaatgatttctttttccatactttctgccgccacatccgcaagctgtaccgggtggcgttccatcacgacagggtcatgctccagaagtttgatagcgtgccaacgtttgttggtgagaccaggatcctgcgccgacaggcggtcgatgagaatgtcaatcttgtcctcaatctcatcactgtacaccattgcgtactctgcatggtgattgtgacggtgggaagagtgttcctccttctcctgatgatgatggatcagcggatcctgggtgataagaccttcgtgatgcttgactgcatgcatcaggatagaaagtccggtccgtttccttgcggataccgggattgccgggatgccaagcatctcagggagacggtgcaggtcgatttccattcctcgctcttctacgatatccatcatattgagagccagtacgactggtttcccaagctcgattaactggagtgtaagataaagattgcgctccagagaggaagcgtctacaacgtccacaatcacatccacatcatcactcataatacactctctggaaacagtctcttccattgtgtaggaggtcagactgtaaataccggggagatcgatcagcttgaaacgatcgccctcgtattctgtcatgccctcttttttttccactgtcacacccggccagtttgccactttcagattggcaccggtataggcgttgaacagggttgtctttccacagtttggattcccgatgaaccctacattaattacctcacccattacttggcctcctccacttcaatatggtcagcaatccgtctcccgagggcaaatcgggtcccacggaaccgaacagtcatggctccctttttatcattatttaaaatggtaatcggagcaccctcggtaaggccgagggcttcgagcctgcgttcgagcgaaagctccagttgaatggagcggacgatgtaggtgtgctggttggttcccatttttaacgtcatgctcattctcctttaaacgacaaatttttcatgcaatatctattatataataaatttgaaaaagcgtaaatatgaaatgcgattccggatgattggactgccgaaaaaacagattgcgctctgatttttcttgcacatctatacggaagtatgataaaatatgaagaaaggcgtaagccagaataacaggaggagcaaaaggcatgggaatgacaatgacgcagaagatccttgcggcacatgcgggattagacgcagtaacagcaggccagcttgtcgaggcaaagctggacgttgtaatggcaaacgatattaccggtccgatggcggtgccggtatttcggcagatggcggataaggtatttgataagaataaagttgtactggtaccggatcattttacaccgaacaaggatatcaaatcggcggagaattccaaatcaatccgggaattcgcaaaagatcagggactgactcattattacgagatcggacagatgggaattgaacatgcacttcttccggagaaagggatcactgtagcaggagagtgtattatcggagcagactcccatacatgtacatatggcgctcttggcgcattttccacaggagtcggtacgacggatatcgccacagggatggcaaccggagagctctggtttaaggtgccgtcagcaatccagtttgtcctcacaggaaagccgggaaagtatgtgagcggaaaagatatcattctccacatcatcggaaaaatcggagtggacggagcattatataagtccatggagtttgtcggagatggactttctgagctttctatggatgatcgtttcaccatggctaacatggcgattgaggcaggggcaaagaacgggatttttcttgtagatgagaaagccgaagcatacatgaaagaacattctgagaaaccatatacgatctatacaccggatgcggacgcggcatacgacgaggtcatcgagatcgacctttctgaagtaagaccaacagttgcttttcctcatcttccgggaaatgcacataccatcgatgagatagaggcgatggagccgatcaagatcgatcaggtcgtcattgggtcttgtacaaacggaagaatggaggatatgagaagagcggctaagatcctgaaaggacataaggttcatccggatgtgcgtgtgatcgtcattccgggtactcaggcaatctacaaggaatgtttaaaagaaggcattgcggagatattcgtggacgccggatgtgcgttctccacaccaagctgcggaccgtgtatgggtggccatatgggcgttttggcggcgggcgagaagtgtgtttccaccacgaaccggaatttcgtcgggcgtatgggacatgtagactctttgatctatcttgcttctccggagacggcggccgcaagtgccatcaaaggctatatcgcaaatccagagaaagcaggtgaatagatcatggaagcaagaggacatgtatttaagtatggagataacgttgatacggatgtgattattccggcaagatatctgaattcttttgacccgcaggagctggcttcccatgccatggcagatattgatcctgagtttgtcgggaaagtacagcctggagacatgattgtcgcaagaaaaaatttcggctgcggttcttccagagaacatgcgccgctctgcttgaaaacagcaggcgtaagctgcattattgcagaaacgttcgcaagaatctttttccgcaatgctatcaatatcggacttccgatcattgagtgtaaggaggcggctgaggagatcgaagcaggcgacgaggtggaaatcgattttaacagcggcaagatttatgaccgtacgaaagggacggagtatcagggacagccgttcccggaatttatgcagaagatcattgcggcaggcggacttgtcaactacacgaatcagaaattaaagggctagctggatcttggtatccggcagacgaaatcaaaagggcggcaccatattcccaaagcgtgccgcccttttggacaatgaatagaatgtttccacggtttgtgggatcattgcagtaagattgagaagccagataaggaggaaaggccatggagttattttataggagcacgagaaacgaaaatgttatgctgaccgcctcagaggcgatcttgcagggactttccgacgaaggtggactgtttgtgccagagaggattccggtgctgaacgtgtccctttcggagattgccgggatggactatcaggagactgcctatatggtgatgaagcagtttctcactgattttacggaggaagagctaaagagctgtattcgtttggcatacgatgaaaaatttgatacggaagccatcgctccgcttgcaaatgtggacggcacatactatttggagctgttccatggcccgactattgcctttaaggatatggcactttccattttgccgcatctgatgacgacggcggcgaaaaagcaaggggtcacggacgagattgtaattttgaccgccacctccggagataccggaaaagcagcgctttcgggttttgcggatgtggaagggacgagaatcatcgtcttttatccgaaaggtggagtcagcgaggtgcaaaggcttcaaatggtgacacagaaaggaaagaatacagcggttgtcgccattcacggtaattttgacgaggcacaaagcggagtaaagcggatgtttgaggatccgaagctcagagaagagctacgtgaagcgggatttcggttctcttccgccaattctatcaatatcggtcgtctggtgccgcagattgtttactatgtttacgcttatggtggtctcctgaaaaatggagaaatccaggagggcgatccggtcaatgtagtcgtaccgacaggaaattttggaaatattttggcagcttactttgcaaaggaaatggggattccgattgcaaaactgatctgcgcctccaacgaaaataaggtgctttttgatttcttctgtacaggtacctatgacaggaatcgtgagtttgtcctgacggaatccccatctatggatatcctgatttccagtaacctggagcgtctgatctatctgatttccggaagaaacgccgataagaactgtgagttgatggaggagcttagaacgaaagggagctacggcatcacggaagagatgaaggcaaagctttcggattttgcagccggctatgcttccgcacaagagatgaaacaggcgatcagggacacctttgaaaataccgggtatgtgatggatacacatacggcggttgcggcggcggtgtacgatgcatataaaaaagattgcggcgatcagacgaagacggtcatcgcatcaacggcgagtccgtacaagttcgcaaaaagcgtgctggatgcgattcatccgggtgcatatgagcaacaggaggagatcggtcttgccgatgaactgagccgtatttcggggacagagatcccattggctgtggaggagatccggcatgcgaaaatctgtcatacgagagaatgtgacggtgcgcagatggagcagacagtgcgggaaattttaggactgagatgatgacaagagattcgatctggccggaacaagttaaattttttatatagagtgttcttcttatcttgatatgatacaataagaaaaaagaaaaggggacaggctatggaaaaaacatatggaatgatggttgccgcctcggtgatagaggaagtgaaaaaggcggtcattggaaaacaggattgtataaaaaaggtgatggctgcgattttagctggaggtcatatcctgatcgaggatattccgggcgttggcaagacgaccatggcagtggcgttttcaaaaagtatgggacttttgcggcaccgtgtccagtttaccccggatgtgcttcctgcggatattgtcggtttttccctctatgacaagaagacgcagcagtttgtctatcagccgggagctgcaatgtgtaacctgcttctggcggacgagatcaaccggacgtctccgaagacccagtcggcgcttctggaagtcatggaggaacggcaggtgacggtagatcagaggacgtacgaggttccggagccgtttattgtgattgctacggagaatccgttcggctctgcgggaactcagatgcttcctgagtcccagcttgatcggtttatgatctgtatctccatgggatatccggatattcagtcagagatcgagatcgttaagggaaatcagaaaggtagtccggcggatgcggtccgctctgtcatggacaaggaccttctgcttgcaatgcaaaaagaggtggaggaggtttatattcacgatgcagtctaccaatatattggaaatcttgtggaggcgaccagaaatcaccagatggtacggcttggcgtcagcccaagagggacgattgctcttgctaaagcagcaaaagcttatgcctatctggagggaagaacgttttgcatcccgcatgatgtggagagtgtcttcccggatgtgacggtgcaccgactgtttttgagcgccaaggcgcgggcggccagaatggattcgacccaggtgattgaggaaatcctgacagggacgaaaaagccgaaggcaggaaaagggagaatagaatgaaaaaatggttgtacctggcggcactgctcgccacatgttatctgaatcttgtctatgactggccggaaggcagaacgattcttgtggtggaactggtatttccggcagtactttatctggaagccaagttgatgagcgttcgtatcaagattcgtcctcagggagatttacagatggcagaagagggggagactttgcatatcccctttgtggtggaaaattgtggagcgtttcggattccggttttgtggctctggatgggaaagaacaggaaggttgtgcgggatctgaaaaaaggcgggcgacagacgttgattttcccgtatcatgccacggtctgcgggaagcaggtgtgggaaatcaaaaaagcggtgacaagggatgcttccgggatgttctatatccggattcgtcgctttgtctctgagccggtggagattcatgtcgtgccgaaggcctatccggtatttgccgagatcagtaaggccgtccgtctcttcgtaacggagggggaggagtatgcaaaagaccggggaggggacgatgcatcggaggtatttgacgtccatgagtacaagcccggggacagaatcgcacagatccactggaaactgagtgcccgtacggaggagctttacttaaaggaattcagctttccgcttggggcggcggtggtggtgctgctttcccggaaagaggaagacaggtttcccgcaaagaatacggtttttctgaatctggcggcatcagtcggacatgcccttgtggaggaatcctgtcgattctatgcagtgtggaaagagcgggaaagccagattttccgcagatttcttgtaaaggatgaagagacgttttatgactggcttttagcgctttcctcgacgcgggtatctgatctggatgtgctggatgaggcgatgtatcggtacgaattttttgaaccttaccggaaagcagtgagaatcagcggggatctctccatccgttgtggagaggaggatacgctgtggtttcacgagaacacgtttgtacaggaactaagcggcacggtattggaaatataaggtgatgagggagtatggacacaaaaacgatgggtaagaatagaggggaacgcttctggcttctgttatcagcatcgttggcaggatcgggactgatctttgcctttgtgccggtgtttggggatgtctttctcatgccggtgcttgcggcagggattgtgtcttttggagttttctggctaccatatgtctggctggaaaacgattctgtagtagggaggcttgtaggaatcttcccggtaatctgcttttttcttgtgaaaagcgaggcggccggggatggcaaggaaatgcttgaacgatctgtttgggcagtcctagcatatatgaaaggagaggaaagcaggattcagatttccctggaaggggaggctctgacatggggactgcttggaatttgtggaatctttctgacagtctgtatgctggctggctctgtccggaaactgcggatcatcacgatgattctgtatgcggcggcgttttccttcccatttcttcacggtctgacaatccagatgaaaggtgcggcgttctttggatgcgcggtactgtgcctgcttctggcaagcccggacagtgccggaaggccccttatgttggcagcggcatccgcacttttgattggggctgtgataccgaagggggagatggagtcattcttttctaatccgattgtctggcagggccggattgccgatttttttacccggacggccatcggcggtgtaacagatgggagaatggggacggtcgatgagatgaaagaaagcggggaagtccagcttgaggtcacgctttccgggcgcccggagagtaccgtttatttccagggatatatcggaacggactaccgcaagaatagctgggtaaaatccggggataccggctccctttccgaacgggaaatcaagacggttcgggaaagggagtatgaaacggcatacgctaaccgggacagacttgactttttgcctgtgaaggcggagattacaagaagaggagccagtcgaaaatacgggtattttccatataaacacgatcagacagagcagatgtatggcgacaccttcagtaaaggacagggacgtacttacacggtggaagcgatccttgccggtgacgtgggagcgatggagaagaatatctcggggattgcatatgagccatccgatgcagcgcaggaatatgaggagtttgtatatgacaggtacctggaagtgccagaagagcttcgcgcaaaatgggagagtactgcgactgcattaagcgggcgtacggttcgggggacggtccaggctatggcaagttatctggatgtgagagccagttatacaaaaagtccggggcggacacctgcgggcgaggacttcattatgtatttcctggatgaaagcagagaggggtactgcgtacactttgcttccgcaggcgtaatgtttctgcggatgaatggaattccggccaggtttgtgtctggatatgttgcaaggccgtcggattttcacgagacggaggatggaacatacaaggcagagattacggatcatgccgctcacgcctgggcagaaatttatctgcccggattcggatggtttccggcagagatgacgccgggatattatgagaatcagttagagggactggagaagatcatcctggataaggatccggaaggagaagatgtgcaggtccaggatccgcagaccgattcatccccggaacctgacagacagcaaaatataccggaagtttcagatgagccaaagcagccggaaaatgacgccaggtccgggaaggagggcgtcaggggaagctctggaaaagaaggagcgataccggtcttcctctgggtagttcctgtgtcggcgttcgtgatggcgtcagggctgttcttcgcttatggcagacagtggaaaaagatccgcacgtctcgcacaaaggaggaaaagtatctgcgtatgtaccggattctctatgggatgctggaatttgacggtaataaagcgcttccggaagaacaggaagcattctgtacagttttagaaacgaagtaccagattgaacgaagccaaacggaaccggtaatccgtcaggtgctgaagacagcgtttgggaaagggaggaccgaaaagacagcgtatagagaattgaaaatactctgccgccaggtgcgggtgaagattctggagaaaaaaggacttttccagaaatttctgttcctctttgggaaaggattctaaataaatattgaaagatgaaggcggatacggtataataaatctaacctgaaatgtacgataactcttgtaattttgaacctacaatactttaaacgggattcctattatctctgtaatatgtcaggcctcatctaatcagtggaagacagaaaagcagatgcggttgcccacctagcggactgctaggagtcaaaatacaggagccggcattttggggggatacacatcaaagagaaagagcagtcgttttacggctgctttttacgttctgtccgggtaaaggacagaaagatacatataaaaatcagcagagacatacattaagataaatgtgatcggacaaggtgcggaagatgaaaaagcgttgggatgggaaatttctgtattatttcggcggtattatcttgagcctttttttatgcgtggggctcgtacatatgataacaggaggagaaagccgggacgagaagacagaactggccgagagcagtcaagagaagaagtccggggaacagcccggggaaaaggagaaagaaaaccagaaagagaaggaaacagatgggaaggcggacaagactgtgatccgggtgctccttcggacgaacggttatgctggagaggtacatcccaatgtttcgctttcggcggcaggaggactcactttggaggggacaaaggaaaagcgggagacaaaggaaggtgagtctgtgacgattgctccggacgatacgctctttcagggtgggacgatccgggtccgtccgaaaaaggagggggaaaagatcacaatttccagtctgaagcggggctctggaattccgtcttaccggggagagctggagctctatcagacggcgcagggaattgcggtaatcaacgaactgccgttggaatcgtatctctatgccgtggtgccgagcgagatgccagcttcctatgaagaagaggcgttaaaagcccaggcagtctgtgcaaggagctatgcttactgtcatatggaggggcaggcttatccagagtacagggctaatgtagatgacagtaccgcttatcaggtctatgggaattcgaaggaacaggagaaaaccatcgcggcggtggatgcaacgcgcggggagaaacttctctaccagggcaaagttgtcaaggcgtactatttctccacgtcatgcggcaggacaacgaatgtggaggcttgggggacgaaggtgtccgatgccaactcttatttaaaagctgtaaaagtggaggaagaaggggtctgttatgaacaggacctgccgtggttttcctggaactgtgatatcccggtggatacgctttccaatctctttggactgaataccggacaggatgtgggaactatctctcaaatcgagatcaccagacggggagagggcgaagtggcgttggagatgaaagtcaccggagacaaaggaaccgccaccattcagacggaaaataagattcggtccgctcttgggggaagcggatacgagattaaaaagcaggacggctctgtggcggcatccgccgcacttttgccaagtgctttttttacgattgagaagaacggggcctcctttcatcttgaaggaggaggttatggacatgggatcggaatgagtcagaatggggcgaatgaaatggcgaaaagagggaaagattataaagcgatattaaaaatgttttacaatggagtggaaattgctgcgaattgatggtatgataactggaaatgaactggaatgaggaacgttatgatcagaaaacagtggagatggataaagaaaattttagaccgggctgtgctaaatcatgtgggcgcatatgcgtctcagtccgcttttttctttgtgctgtcactgattccgattattttactgcttctgacgatggtacagtacacgccggtaaccaggacagatgtgatgaaagcggtgacagaagtttttccaaaaacagtcacgccgtttctgatttccatcatcaatgaggtttacagccagtctaaggcgatgatccctgtgacgatcctggtggcgctgtggtctgcgggacggggtgtacttgccataacatcagggcttaactgtatttaccagagcaaggagaccaggaattatttttatctgcgtctcagagcttccgtttatacggtgctctttcttctggtgattatctcctgcctgctgctggcggtattcgggaataaaatcagtgtgtttgtagagatgaatgtaccggttctggaaaaagcggtggagtttttgatccgaatccggacgaccctgacaatcggagtgatgatgttgttctgtatgttgttgtatcggtttcttccggatgtgaagatcaagacgaagtggaaacatcagattccgggatcggtattcagtgctgtcggatggcaggtgatttccctgattttttccgtctatctggatatttttgaagggttttcgaccatgtacggtagcctgacaacgattattttagttatgctttggctgtatttctgcatgtatatgattttgcttggcggcgtgattaatatcacggtctttcgtgacaatctggataaagaccttccacatgatcctgatgtgcgggattttggtaatcttttgcaatgatcaggataagacttgacagaagacatctcggacagtatactaaaagcgcaaagttacagaaatgaggtgaaaggatgatcgatacttcctgcaaattttaagacaatgaaacagataagtacacggaagatgcgagaggcagattctgtgtgtacgcattgcaggaagcgacattctttttttctatatttgatgaagaacaggcggtggccatgaaaagaggagcttttcatggcttctttttatggcagcggtccggaggtatgcagctttctgcgtgtgtgccgtaaaggaggatgatatcatgtcacagattcaggttacagatcttacattttcctatgacacccattatgagatgatttttgatcatgtcaatgcccttctggacacaagctggaagaccggtctgattggcagaaatgggacgggaaagacaacatttttaaagcttctcaagggggaatacccgtacagaggtaacattcagatggcagagacggcggagtattttccgaccgtgatccgggagaaagacagagcagcaatggaagttctggaagagattgatccggagtatgaattctggaaggtattaagagagatggaatggatgggtatggacgcggggatactggagaggcgatacgggacgctcagtccgggagagcagatccggatgcagattgcggtactgtttgccaaggagcatgcctttttgttaatcgacgagccgaccaatcatctggacgaaggaggaagagagatgcttgcctcctacttaaagaagaaacagggatttctccttgtctcccatgacaggaaacttcttgattcctgtacagatcatacaatggcgcttgagcgctccggcatccggatctatcggggaaatttcagtacgtggcagcgggaaaagaagctgcgggatcagatggagttgggaaaaaacgagaaattaaagaaagaaatccggcactatgaggacgctgccagagaagcgggacgatgggccggaaaaaaggagaaggaaaagaccggacacaggataggaggcttaaagccggaccgtggcgcgatcggacacaaagcggccaagatgatgaagcgttccaaggtactggagcatcggatggagcgggcggcaagggaaaaggccggactgttgaaaaatatcgaggaaacagaagcgttgaaaatgtttccgcttgtctatgacaaagagcgtctggtgacggtggatcaaatctcctttgccagaggagaacgacagatttttcgggaattctctctggaaatccgcagtggcgaccggatcgccctgaagggaagaaacggctgtgggaaatctaccctcctgaagctgatcgcgggggtggaagagccggacgcagggcagatccgtattggcagcagattgaagatttccgttgtcagccaggattcttccggtttgaaaggaactttggaggagatggaagagagggcagggctggaccgggcactgtttcgggcggtgcttagaaagctggatctttccagagatcagtttgacaaacggctggaggagtatagcgagggacaacgcaaaaagattcttttggcaaaaagcctctgtgaaccatcccatctgtatatctgggacgaaccgctcaattatatcgacatttttacgaggattcagatagaggagctgattctttcccgccagccgacaatggtctttgtggagcatgacagtgtctttacaagccgcactgcaactgaaatccggtatctggacgaagcgtccggtacgggaatttagaggtaacagttcagtcatgcacaaagtcacatttgggctggactttgacttttacagtgagatttggcggatccggtcttgacaaaggggaaagggatgtttaaaataaagaagatatagtaaaggctgtgaatgtgtcagtagggtatctgatcattgccagagagaaggggccggaggctggaagctcctttctattcgacagatatactgaatttcccgcaggagccgcatttccgaacaagtagtaagaaatgacgtcaacgtgcacgttacgcataggaagagagcctgtctttttacgcaggaatcagggtggtaccgcggattgattctccgtccctttttggggcggagttttttattttactgaaaatcaggtaatatatcagaagtccctgtgaaacagatattggtagttaaaggaggaacaacatgaaagaaaagcttcaaagcatcagagaagaggcgttaaagcagatccattctgctgatatgccggaaaaattaaatgatgtaagagtcagatttttaggaaaaaagggagagcttacggccgttcttaaaggaatgaaggatgttgccgctgaagagcgtcctaaggttggacagatggtcaatgaagttcgccaggagatcgaaagtattctggatgagacgaagaaaaagatggatgagaagatccgggaggaaaagttaaaagcagaagtgatcgacgtcacccttccgtctaagaaaaatgtagtcggacaccgtcacccgaacacgatcgcccaggaagaggtggagagaatcttcgtgggaatgggatatgaagtcatcgagggaccggaaattgagtacgacctgtataattttgaaaaactcaatattccggcagatcatccggcaaaggatgaacaggatacgttctatattaacaaggatatcgtcctcagaacccagacctccccggtacaggcccgtgtcatggaacagggtaaacttccgattcgtatgatttctccggggcgtgtgttccgctctgacgaggtggacgcgacccactccccatctttccatcagattgaaggactggttatcgataaaaatatttctttcgctgacttaaaggggacgctggaagtgtttgcaaaagagctgttcggcccggagacaaagacaaaattccgtccgcatcatttcccgttcacagagccaagcgccgaggtggacgtgacctgttttaagtgcggaggcaaaggctgccgtttctgtaaaggatctgggtggatcgaaatcctgggctgcgggatggtacatccacacgttcttgaaatgtgtggtatcgacccgaatgagtataccggatttgcgtttggagtagggcttgagcgaatcgcccttttgaaatacgaaatcgacgacatgagactgctgtacgaaaacgacatcagattcttaaagcagttctaagaggaagggagaacagacaacatgaatacatcattatcatggataaaagcatatgttccggatttgaatgtgacagagcaggaatatacagatgcgatgacgctgtccggaacgaaagtagaaggatatgaaaagatggacgcggatcttgataagatcgtagtcggtcagatcgaaaagatcgaacggcatccggatgcggataagctcgtcgtctgccaggttaatatcggaagtgaaaagattcagattgtgacaggtgccccgaacgtagaagagggacagaaagtcccggttgttctggacggcggaagagtggcaggcggccacgacggaagcctgacaaaaggcggtattgagatcaaaaaagggaaattaagaggcgtggagagctgtggcatgatgtgctctatcgaggaattgggctctacaagagacatgtacccggaagcgccggaaaacggaatctatatcttcccggacgacgtggaagtgggagcggacgcagtggaagtattgggactgcgcgatgcggtatttgaatatgaagtgacgtcaaaccgtgtagactgtttcagcgtcataggaatcgcaagagaggcggcagcaacttttggaaaaagtttttatcctccgattgtaccagagactggaaacgacgaggatgcttccgattatatcaaggtagaagtaaggaatcaggaactttgctcgcgttattgtgcgagagtggcaaaaaatatcaaaatcggcccgtcaccggaatggatgcagagaagacttgcttccgttggtatccgtccgatcaataatctggttgatattaccaattatgtgatggaagaatacggacagccgatgcacgcatatgacctggatacgattgcgggacatcagatcattgtcagaaatgcagaagacggtgagacatttaccacactggatggacaggaaagacagcttgaccgggatgtcctgatgatctgcgacggagaaaaatccatcggaatcgctggaatcatgggaggggagaattccatgattacagatcatgttcacaccgttttgtttgaggcggcatgttttgatggaaccaacatccggaaatccagcaaacgtgtgggactgcgtacggacgcatccggaaagtttgaaaagggactggacccgaataatgcaaaagcagctatcgaccgtgcatgccagctcttagaagagatgggagctggagaagtggtaggcgggattgtggatgtttacagcaaggtaaaggagcctgtacgggtgccgtttgacgaaaacgccgtcaatcagcttctgggaactgatatttccaaagaagacatgattgcttatctggagaaggtagagcttgcatacgatgaagcaacaaatgagatcgtagcgccaactttccgccaggacattttccgccttgcggatctggcagaagaagtagcaagattttatggatacgacaatattccgaccacccttccaagaggagaggcgacgatcggaaaactgtcgtttaaacagcgcattgaggcggcagcaagaaatattgcggaattctgtggattcagccagggtatgagctactcttttgaaagtccgaaagtatttgataagcttttgcttccagaggacgcaccggaacgtcaggcaatcgagatctccaatcctctgggagaagactatagtattatgcgtacgatttctttaaatggaatgttgacttctcttgcaacaaactttaatcggcgaaataaagacgtcagattgtatgagcttggtaatatctatctgccgaagactcttccactcacagaacttccggaagagagaatgcagtttacccttggtatgtacggagagggagacttcttcagtatgaaaggcgttgtagaagaattttttgaaaaaatcggtatgcacaaaaaggaagtatacgatccaaatgcaggaaagccgttcctccatccgggacgacaagcgaacattctttatgacggaaccgtggtaggttatcttggagaagtccatccggccgtggcggaaaactacggaatcggcggacgcgcctatgtcgcggttctcgatatgccggagatcatagtacgtgcaacctttgacagaaagtacacaggaatcgccaaattcccggctgtgaccagagatatcagtatggttgtaccaaaggaaattctggtaggacaaatcgaggaaatgattgagcagagaggtggttccattctggaaagctaccatctgtttgacctgtacgaaggggctcagattaaagaaggacataagtccgttgcatattccatcgtattccgtgcaaaagacagaacgcttgaggatgctgacgtgacaaaggctatgaagaaaatcctgaacggtctggaaagtatgggaatcgagctgagacagtaaagagggaatcgggccatgatgaaaaaagaagatttttattttaaacttcccgaagaattgattgctcaagatccgctggaagaccgatccgcttccaggctccttgtccttgacaaggagtccgggaagatcgaacatagaatgttccgggatatcaaagcatatctaaagcccggggattgcctggtgattaatgacacgaaagtcattccggcaaggttgatcggatccaaaatcggaaccgatgctaagatcgaaattttacttttaaagagaaaggaaaatgatatctgggagactcttgtcaagccagggaaaaaggcaaaaccgggtacaaaaatcagttttggagaaggccttcttatcggtgaggtgatcgacgtcgtagaagagggaaaccgtctgattcagttttcttatcaggggatttttgaggagattttggatcagcttggacagatgcctctcccaccgtacattactcatcagcttgaggataagaaccgttatcaaaccgtgtatgcaaaacacagcggatctgcggcggcgccgacagcaggattacattttacaccagagcttctgaaagagatcaaagaaagtggtgtggatatcgcccatgtcactctccatgtgggacttggtacattccgtccggtcaaggtggaaaatattcaggaacaccatatgcattcagaattttatcatatcgaggcatccgaggcggaaaagatcaaccgggccaaacggggaggacaccgtatcatctgtgtgggtacgacgagctgtaggaccattgagtctgcggcaaagccagatgggacgctatcggagtgcagcggatggacagagatcttcatctatccgggatatcagttcaaagtactggactgccttttgacaaacttccatctgccggaatccacgctgattatgctggtcagcgctctggcgggaagagagcatgtgctccatgcttatgaagaggcggtaaaggagcagtatcgattcttcagctttggggacgcgatgttgattgtttaaaagaaaataagatatgacgggtgaaaatggaaaaacctggcggtttaggataaggaactgtcaggttttttacgtgatgaatctatatgtccgaaaggatgtaatcggttgcaagggtagtgcagatggttatggttttctgttcagaaagatcaggagcatctgcctgtcattttcacttgcatcacggaaattttcgatcaggtttacttcctgatccgtaagatatagcgtgtggatgtgatcgacagtttcgctatgacggtatttatagatgggcatagattcccggatctggtcggcatgaatgttgcctgcaataagttcgtccaaagtgacctgataaaatcgggagagatgaaccagtgtattcagatccggctcccgaagtgcctgctcgtagtgagagtatgcctgtctggtaatattcaaaaaagtacttacgtcttgctgggtatagttgtattttttgcgaagtgtttttaaattttttgcaagctgtacatttgccataacatacctccagtttcttagcagtatatcagttttttgctgtaaattcagaggatgtaacaaaatgtatcttaatgatgaaatgcaacgaagtgttgcgatatgaatagagctgctgtagcgtttttatgtgtgtgttattttgttgtgtccttgtttggatatattatgatagtattggacgatattttggtattgcattgtcttaaattatgatactattatattgtttaataagagtagagccaagtcgggggttaagcgggtatgtttttccagtatggtgaaaaagaaattacatacttaaaacaaaaagataaatgccttgcggaagtgatcgataaaatcggaaaagtcgagcgtgaggttgacggcgatttgttttcttcggttattcatcatattattggtcagcaaatttctacaaaggcacaagcaacaatatggaagagaatgaaagaaaatcttggcgtagtaaatgacgataccattcttactgcggggattgaacgtttacagacctttggaatgactttcaaaaaagcggagtatatcatggattttgcggtgagagtacgaagtggtggttttgatttacagggcatttgggagaaaacggataatgaaagattacgctcccaaaacaggaaataagaaaagtgaacgaacacgaaaaattacgagcaatccaaaacagggatagaccacacctataccatgtctgatagaataaaagcccgtgcggactctgatgaatatatggaggtataagcttatgacctatacaaatcactatgattcacctttaggaggtatcacactttccagtaatggaacagaacttacaggcctttggtttgacggacaaaaatattttggcgatacacttccgaaacactatgaagaaaagtctttgccgatatttgagcagtctgcccgttggctgaatatttattttagtggtaaagcgcccgatttcacgccgccgctatctatgcagacaacgccgtttcgtaaagcggtatgggaagtgatgttgactattccatttggaaagacaatgacttacggtgaaattgcgaaaagaatagcacaacaaagagggctatctaaaatgtctgcacaagctgtcggcggtgctgtgggacataattctatttctctcattattccctgtcatcgtgttgtcggtacgaacggaagcctgacaggatatgccggcggcattgagaaaaaagtgcagttgttaacattagaaaaaacagatatgtccttatttttcgtaccgaagaaaggaacagctttgacattgtaatctctcgccttgcttttcatcattttcccaatccaaaatgttgtttttcagaaatggcaagggttttgaaaacaggtggtaagctggttgtcattgatatggaagcggccgaagaagcattgcgtaatacagaaaatgagatagaaacattgcgtgatccctcgcatgtgcgtaaattgagcaaggaggaatttacagaaatgttccgaaagaactgtttgtccattatgacattggagtgcacggaacttcctgtttcgttatccgcttggctaaatctcacaaatacacctgcggagatatgcgcagacatatccaaacggcttacagatgaaatgaaaggcaatggattaacaggttttcattcttatcaaaaagatggagaaatatattttcatcaacgatggcttatgatgatcgggaaaaaggaaggaaattattatcaatgaaaagttgcccttgttttggtttgtaagagtaaaatcaaaggcaaacagataagcttgagagaccaatgatttttggatcaagacagctctttccgatacaccttagattgcacacctacggcattttccatcatgtcgtaaaaggaaaagccatatttttcataaagtccggtttccccggtggcaacgaacacttcttcagccccatcatttcgggcagtttcacatgcaaaatttaatagcgttctcatgtaatggcgccctctgtaagcaggataggtatagacaaatccaatccatggagacttgtccgtctttttgatatcatctacatccgataaggtacaaaatgccgcaagttttgtgccatctgtcaaaagaaacagtctcacatgttctccgcaaaatttatgtatctggttcgtggtcagcagttcatacagaaattgtccggcgggccagtcgcatgtttgaatcattgcaagccagtgtgtccggtccttcgatcgaaaaaattctttgatttccataagattctccttttatccggtttttttcattttacaccattttcaggggaaatcaaatacttttcttggaatacggtatatgatacactgatgataataagatagggagaagggagtaaaatcatgcggaaaggatcgacgcaaagctgcaatagttgtgcttattatatttttgacgaggaatatggcgaatatatctgtgacgttgccatggacgaagatgattatatgagacttcagctagagcctcattactcttgtccgtattaccataatggagacgagtaccgaattgtgaggaaacagatgtaaatggatagtaagtagaaaagaggagaggcttatgaaagaggaagaaaaaatttttgcaggttatatgtttgatccgagaaaacaggagctaagagaaatcaagcataaagcgcatgaagcatgtcggcagtataatgttttggatgaatatgacccgcggcgggaggagattctcaggggtatgctgggaaaggtaggacaggtgttttattttcagggtcctgttcagtttaattacggttcgcatacttttattggagaaaatttttttgccaattttaatttaacagtgatggatgacgggaaaattataattggagatcatgtttgctttggaccaaatgtttctttgatggcgacctctcatccattgatttcccaggaaaggatgggactgaatcaggaagggaaaactacaatggcagaatatgctccggagatcgtgattgggaatcaagtgtggattgcatgcaacacggttgttcttggcggagtccatataggggatggggctgtgatcggtgcgggaagtgtagtgacgaaagatatcccggcacattacttggcatttggaaatccgtgcagaccgattcgtccaattacggaagcagacagtaagcgatccttgattttaccggaagatcaagagcattttttctataattttaagcagtagaagttgaatataacagcgaagataaaaaggagagcaaagtgttatgataaatggatttcggatcatcaatctgagagaatccccagagagaaaacaggaggcggcagactggtttcatcaaaagtggaaggtacctctggaggaatatgagaaaagtatggagaaaagccttacgggggaagcggcagttccccagtggtatctgacaatcaggggaaaggagatcatcggtgggcttggtgtgattgaaaatgattttcacgatcggaaagatctggcgcctaacgtctgtgccgtgtatgtagaagagccatacaggcgccggggaattgccggaaacatgctggcttatgtatgtggggatatgaaagcacggggtatctccactctttatctcatcacagatcacgatacattctatgagcgttatggatggaaattctattgtatggctcaaggtgacggagaagagaagatgtcaaggatgtatatccatcaggaggagtaagagatgcttataggaggagaaaaggaaggtgatagtctcaggattcgagagtatcgcaaggaggatggcccggtactggcaaagcttttctaccagactgtacatactgtcaatgtggctgattataccaagattcagcttgatgtctgggcgcccaaaaagagagatttgaaagcatggaacgcgtcttttttacgtcaccggacggtggtggcagaactaggcggacagattgtgggatttggggatatggacaaaaccgggtatctggatcggctgtatgtccaccgggacttccagggacgacatatcgccacggcgatctgcaatgaactggaaagacaatctggagtgcatcggttcgaaacttacgcttccatcacagcgcgaccgttttttgaatcaagggggtacgaggtgatacgggaacaggaagtaaagcggagtggagtcactctgagaaactatgttatgtgcaaaagaaaaaagtaaaggagaaaaagtatgaaattgttaatcaaacagagggtattttcatggacggatacctatgatatttacgatgaggatgggaatgtccgttactttgtaaagggagattttttctctatcggacacagattgagagtgtttgatagttctcagaacgagatcggtctgattcaggaaaagctgcttcacctgctcccgacctttgaggtttatgtaggtggtcagttttacggaaaagtttccagaaaaataacattcttacggcccaaatacatagtggattacaatggatgggaagtagagggcaatatgatgggatgggagtacgatgcttatgctggcggggttccggtcatgcatatatcgaaagagattttccactggggagacacttatgtgatagatattgctaattctgcagatgaaatgatggctctgatgctggtactggcgattgatgccgcaaactgccagtcctaaaggaatatacagatgaggtggaggcggatagtcgaagcggaagaagacaaagaaatcaggtacgatgcgggaagaaagcagaaaaccggattgacaagtaaatgcaaatgtgttatagtcgttccaagcaatggaaagggagtagcttaagccttcttcggaaggtcgatttgtaatcgtcagccggtaccgagaggtacccgtagcaaatgagatagcaagacttttattgtgacagatgtcatgatagaagtctttttttgtattggggactgtttacaatttcgaaaggtatctttcagcgcttccgatgattatttcatatgggcatttttcatggcagaagccagcagattaaatgtaggagaggaaaacgatatgggagaagttcgtttaaaagaggatttaaggtgtgcagaggagtcaggagagcaggcacttgcgagtctatacgcagtaagagcaaagttaaatagtgcgaagaaatggggaattctggacatctttggtggaaatctgatcagttcttatgtgaaacattccaaaatcaacgaagtggagggactgattgagcagtccagaatgaaactgacggattttcagaagactctgcgaggcgtggagatcccggcggagctcaagatggaagtaagcagtttcctgacatttgcggattttgcttttgataacccagttacagattaccttgtacagacgaaattgcagacacttggtgaggaggtcgaggatacgattcagttgatggaaacgctgctggaacacatccgtgagcagtaagaaaagggaatagaaaataaaatgtctctgtctaataatcatcgagctaccattttatttagaatattttatgcaggcgctgatgccattcagggcgaaagcttgttaagcattaggcagtacccggtaaaaacgtagaattgcaaatacggttatagaattaaagaaaaattaaaaaaagattgacagaactacaggtgtacgttatactggcaacagtaaagaaaataagatagcgtgttactgaatttcaggcatgaactatcctttgtatttcgtttagaagacgaagtgtaaaaaggacagttcatgcttttttgttctcagaaaagggatgggggaatggggagtttcctgagtttgggtacaaagcagggaaaaacatgctgtcacaggaagggaaaggagaccaacatgaaagacaaaatttttggtgtgcttcagagaatcgggcgaagctttatgctcccgatcgcgattctcccggttgcgggccttttgcttggaatcggaagttcgctgacaaacgcaacgacgatcgagacctacaatctgacgggcatcctgggagaaggaacgattttaaatgcgctatttaccattatgacgaaggcggggaatgcgatttttgataatctgccgatcatttttgctgtaggagtcgcaatcggtatggcaaaaaaagagaaagaagttgcggcgctttccgcaatgattgcatttcttgtaatgaatgttacgatcaatgcactgctccagatcgacggaaccgtgctggcagacggaaccatctctgaagatgtgttaagtggtacggtcgcaagtgtacttggtatccagacattgcagatgggtgtgttcggcgggattatcgtcggacttggcgtggcggcgcttcacaataagtattacaaaatcacgctgccgaatgcgctgtccttcttcggtggctcccggtttgtaccgattatttccactctggtatatgttggagtcggaattcttctgttttttgtatggccgtttgtgcagaatggaatttacgcactgggaggactggtgacgggaaccggatatttcggaacattgatcttcggtattatcaagcgtgctctgattccatttggcctgcatcatgtattttatcttccgttctggcagactgctgtgggcggaacaatggaagtagcaggacagcttgtacagggaggacagaatattttctttgcccaactggcagatccaagcaccgtacatttcagtgcggacgcaacgagatatttctcgggtgaatttatttttatgattttcggacttccgggggcggctcttgccatgtatcactgtgcgaaaccggaaaagaaaaaacaggcgggcgggcttctgctctccgcggcactgacctgtatgctgacaggaattacagaacctttggaattttcgttcctgtttgtagcgccattgctgtttggcgtccaggtcgtgctggcaggctcggcgtacatgatcgcacacatgttaaatattgccgtgggactgacattttccggtggattgatcgatctgtttatttttggaattctgcagggtaatgcgaagacgaactggatgctcattattccggcaggtgttatttattttatcctgtactatgtaatattccgtttcctgattcagaagtttcagttcaaaactccgggacgggaagatggagacggcgagacaaaactctatacaaaggccgattataaggcaagacagggagagcagacaaaaagcggggatccggcaggcgatgagagaagtattctgatcacgcagggacttggcggaaagaaaaatatttccgatgtggactgctgcgctacaagactgcggtgtactgttgtgaaaccggagctggtgaacgaccaaattctaaaacaaacgggtccgtccggaattgtaaagaagggacaggggattcagataatttatggcccgtccgtaacggtagtcaaatctaatctggaagactatcttgtaaacgcgccggatgaagagtatcttgcgccggatgaagaaaacgtagaggaaaaagaggtgcgggaaacaacgccccaaaatacagaagcaaagacaacgaaaaaagtattatgttctccatttaccggagaggtgcatccgattgctgatacgccggatgaggcgtttgccggcaagatgatgggagacggatatatggtgatgccggtggaaggtgtgatctatgctccggaggacagcaatgtaacatttgtattcccgacgaatcatgcgattggtctgacaacggttgacggagtagagtatctgcttcatatcggggtggatacagtgaagctggaaggaaaaggctttgaaatgtttgtaaaagacggggattttgtgaaaaagggagacaaactgatggcttttgatatacaatatataaaagagcatgcgaaatccgaagcctgcattgcggtattcacgggattgacagaagaggaagaagttgtgatgaaaagatccggccatgtaaacgagcaggaggagatagcggaaatcgtaagctgctgattgtaaaggagcttatgtcagatgtatcgaataatcaaagtgttaaataataatgcaatcctggcactggatcaggaaaagaagcgggaaatcattctgcttggaaacggaatcggctttggcaagcatccgggcgaagagatcaagatgatacaaagtgcgaagatctatacgctggtgacaaagaagaagcagacgtctgccttgaaagtcgtcaatgggatcaagccggtatacctggaggccacaggcagaattctggaggaagcggagagggtatttgagaaagtcagccatgattccctgcttccactggcagaccatatcgcccttgcggcgaaacgggcagaggagaaaatgcagattccgaatccgttcaccccggatatcaaagtattatttgagaaagaatataaagtcgcccttaagggcagagaaatcatccgggagatgacaggggctgagatttcggacgatgaggtaggatttatttccctgcacatccattcggcacgatctgatgagaaagtctccgagacactggataatacaaggcttatcaacgaggggatccgcatgattgaagaatatttccagattgatctggagcaggattctttagggtataaccggatgatgagccacatctactatatgcttgtgcggacgagaaaaggtgagcaggtaaaggcggatttgaatgattttgttcaggtaaaatatccgaaagaatttgcggcggcagagaaaatctgtgcctggatagaacaagaactgaaaaaggaagtcaggatcgaagagatcggatttcttgcaatccacattttgcggattgtaaatcgggaatagcccgggcgaatcggaaaatcctgaaagattctccccgcagggaacatcaaactggtcgtttgatccggagtcctgcggggagattttatgtctttttatatgattttcgtcgtccatttggtacagtcccagacttccgatacaacgtcccggtaaaactccggttcgtggcagatcagaagaagacttccccggtattccaggagcgcttttttcaaggaatcttttgcgtccgtatccagatggttggtcggctcatccagaagcagaagattggtatcacggtttacgagtttgcacagacggactttagcctgctcccctccgcttaatacccggatctggctttcgatatgtttggttgtcaatccgcatttggcgagagcggaccgtacctcatattgggtaaaggatgggaattcggcccagatttcatcaatacaggtagcagaattttcaccctttacttcctgttcaaaatagccgatctgaagattttcacccagttcacatgacccgctaagcgacgggatcaatcctaaaatactctttaaaagtgtcgtctttccgattccgtttgccccggtcaatgcaattttctgtccacggtccatggaaatggacagtgctttggagagaggctcggtgtacccgatcaccagatcccttgtctcaaagaggatacgccccggagtccttccgtaacggaaatgaaattccggttttggccgctctgttcccagctcaatcttctccatcttgtccaactttttttggcgggacatcgccatgtttcgtgtggagacacgcgccttattgcgggccacgaagtctttgagttcattgatttcctgttgttgacgacggtaggccgcctcaagctgcgcttttttaaccgcgtacacttcctcgaagtgactatagtttcccacataccggttcagttcctgattttccatatggtagatgatgttgacaacatcgtttaaaaacggaatgtcatgggaaatcagaataaaggcactttcgtattcctggagatagcgcttcagccaggaaatatgctcctcatccaggtagttggtcggctcgtccagcaaaaggatgtccggtttctccagcagaagctttccaagcagaatcttggtccgctggcctccgcttaaatctgttacgtcccgctccaggccgatatccagaagaccaagtgctcttgcgacttcctccactttgctgtcgatggtgtagaaatcgtgcatggtcagcatgtcctggatcgtcccaagctcttccatcatggaagtcatctcttcctcagatacgcttccaagacgatcacagatttggttcatctgttcttccagatcaaagagccaggaaaaagcggatttcagcacgtcccggatggtcatcccttttttcagaacggtatgctgatcgaggtagccggcacggacgtgttttgcccactcaatcttaccctcatccggtgtcaaatggccggtaatcatattaaaaaaggtggactttccctcaccgtttgctccgacaagcccgatgtgctcgccccggagaaggcggaaagaaacgtccgaaaagagcgcacggtcaccaaaaccgtgtgtcagatgttctacagttaaaatactcatacaataaaactccttgttctacagtcttttcctattgtacaggaagtctgcctttttgtcatcagaaaaagagaagagaatcttaccggcagcttgtcttaagaggaaaatctggtacaataaaagtagagtgaaaggagacttactgtgaaaaacataccagaagaatttcaaaaagattatatcagaacaatgcggaagatgatcgggcacgcaccgcttgtgatgacagcatgtggagtgctgatcgaaaatccgaatggagaattactcttacagcgccggaaggataatggactttgggggcttcccggaggggcaatggaaccgggagaaacgtttgaggaggctgccagaagagaggtaagagaggaaacgggacttcttgtaggggaactgaagctggttggaatttattccggaccggatcagattcttacttatcccaatggggacgtttgctgctatacggggattgtattctatactacccagtttatgggagagctgctgcaagagacgaatgagacgtgggaacatcgcttttttgcaaaaagcgagatcccggatacagttacctcgtatgatcgccgaatggtagatcgctggatttccggggagaaagagcttgtaatcatataaaaataacacgataggaggcagatacagtgaaagtaggaattattggagcaggcgggatcgccgttactatggcaaggacactgaatcaaatggaggacgctacggcgtatgcggtagcgtcccggtcgttagaaaaggcagagacctttgcaaaggaacaccaggtggaaaaggcatatggatcttatgaagagatgttacaggatccggaggtagagcttgtctatgtggcgacgccccattcccaccattatgagtgtatgaagctggcgctttgctatggaaaaccggttctctgtgagaaagcgttcaccgccaatgcagagcaggcggaagagattttgagtatctctgaggagaaaaagctgtttgtcggggaggccatgtggacgcggtttcttccatcaaggaagatgattgatgaggtggtttcctccggggagatcggacaggtacatatgattaccgcaaatctgggatacgacatccgcatggtggaaagattgcggaatccggctctggcaggtggcgcgcttctggatgtaggtatttacccgctgacgtttattcgaatgattacgagttcgaagatcacctccatagatacgtcctgcgtgaaactggaaaccggggtagatgctcagaatacagtgacttttgtctttgaagacggatgtatggcaacgatgcacagtagtatgcttggaggtacggagcaggcgggaatcgtgtatggagacaagggatatttgattgcatggaatatcaataatgtcagtcatatccagatctttgacaacgaccggaaactgcttagggaagagaaagttccggcccaaatcacgggatttgagtatgaagtccgggcggctatggaggcaatccgggacggcaaaatggaatctccgcagatgcctcacagcgaaaccctgtatatgatgcggctcatggacggcttacgaaagagatggggcgtccggtatccgtttgaataacagcaaagattcatataaaataggatccgctgtcatagaaggtcgcttgatgagaattagccaggattcatcagcatgcttcaaggaaagaggaaaagattcggctcattttccgggaggaaaggtacatacattccgggtgccactggacgccaaggagaaacgggtgcgattcgtcttcaatggcttcgatcactccgtccggagatacagcacagacgcgaagaccggatccgggttccttgacagcctgatggtgaaagctgttgacttttgcctgtttaccgatgaggtgggagaggagagtctgctcttcgctctggatcaggtgaaccggatcatgccgaaacatggcattgggattatggttaaagaagctcggattttcggacagatcctgatagatcgtgccgtggcaggcaagatttaatatctgcatccccttgcagatcccaagtacgggtttgtcagaatgatggaatagaaaagacgcaaaatcgagctgaaagcggtcgaattcatagtccgtagcgccaagatggcgggaaggcatctgatcgaacaacaggggggtgacgtcctcgcctccgcagaaaagaaaaccatcgcagcgtttccagcacgcatggaaaaaagagacgtctgcatcttcgaagaagggaatcagaaaagggagaccaccgtgatctgcaatcgcctgaatataggggagacttacaaagacgcgtccgcgttctctggcgcagacaacgataccaatggaaggggatttctgtttcatatctgatttcctttctgattatattagattataatggtatcagtttatgaaagggagtcgtttcttatgaatctgattgacatgcactgtgacacaatctgtgaattgctttcggagaaaacgccgggtcaggatctgaagaagaataatctgaaagtagatatagaaaaactgaaaaagggaggttcggcggctcagttttttgcctgttttgtggcaatggatgaatttctggggaagtccaggtatgagcaggcatatgaatatgtcagaagaatggcggcttatttgaaaaagcagatctggatttattccgacgacatcgcttttgccggaaaaggagctgatctggaagaaaaccggaaaaaggggaaactgtcagcatttctgacattggaggagggaggcgtcatccacggggatctggaccgggtaaagggactttacgatatgggaatcaggctcatcacactgacgtggaattatgaaaactgtatcgggtatcctaacagccgggatctgaaggacatgggaaaaggactgaaaccgtttggattttctgtgatcgatgagatgaaccgtctcggtatgatcgtcgacgtctcccatttgtcggagggtggattttgggatgtggtgtcccacagtaagactcctccggtggcatcccattcaaatgcgagagcgcttcgggatcatcctcgtaatctgtctgaccgccagatccgggctttggcggagaagggaggcgttgcagggttgaatttttatcagaatttcttgggagagagcggttcatgccgaatcgatgagatggtcggacatgtccggcatatgtaccgcatcggtggagaggattttgtggcggtggggacggattttgacggatttagcggggcgaaagagatggagatttcagatatcggggagatgccactgctatccgaggcgttaaaaaagtcgggatttacctggcggcagattgaaaagatctggtatggaaatgcaaagcggatgattgacaccgttttatgacgggaaagggtgaaaagtatgaagatacgaaaagctgagaaaaaggatttggcggacgttgcccgtatccacgtggaggcgtggaaaagtgtttatcgtgggatcatgcctgatgaagtattggacgcaaggaatctggatgcacagcaaatcgtgtggggagaagagctcgataaaggtgcaaagctgtatgtctgtgaacaggaggggaatatcgtaggatttgcttcggggcatgaggtggatgcatttcatgcggagattgacaccctctattttcaggagagtgacagggggaaaggatacggcttgcagatgttggattatatgaggcatgtcttaggagaagagaaacaaatttccctttggtgtgtgaaagaaaatcctaacagaacattttatgaggccaatggaggagagacgggattggagaaaacagtacaaattggcgggaaagagattgccggaatccaatatctttttgagaagcgaaggaaatgacatagaattatcaaaagcggttcgtctgttttggatgaaccgcttttataaacagatttctgttgtacgattgtaaaggctgcttttggtgccaatcacaggggtgattctccgctgtcatagacattcttatcatcatgcaagattgggatatcggacaccctggaaaaggacatggttttcgatcctgtatccagttccatctgactgtcgctaagcgtccggatcgtccagcctttcaatttcccggtcagaattttcccggtattggatttgtatgtatattcatacgtgcctgtataatgtacagaagagtctccgtccacttcatcataataatagatgttttcactaatatcgaatgagatatgagaaaaggaaacgtcgtcgttttcatagcatccatgcagggcatattcatggtgtaccgttttagaataaataaaaatgaaaccaatgacaaatagaataccggacaaaatgacaaggtataatttcttcttcattgtttcttctccctttttatccgtatatagcaggtcatacagatattaccggcttccttcatttactgtaatccaataccgctcaaagttgacctggccttccggctcatagacagtaccgtcatagataccgccgtttgccaggatcgtttttcggcttgcggtattggtatccatacagcaaaccaacacacggtcaaggccgagactgcggcagtatggaagacagtcatggagcatctttgttgcatatcctttctgccgttcacttgggcggatggaatagccgatatgtccgccgtaagtttccagaaatggagtgaatgtgtgacgaatctggatcgttccaagaatcttctggtcggattctcttacatagataaattgggtagatggaaccatatcctcaggaatgtcttctccgagttcaaaacgctgagtgtgaactacccactgggccgggtcttccatgtcagccagggggccgcagccatttaacggactgccgagatcaagaaattcctgacggtaagcacgaatctcatcggaaaaggagaggttcggtcttattaaagttagtttttccaactgatttccctccttgcagatattatatatttattttaacaggaatagagtgggaaatctactgcaaattatatgcccaagctatctgtgttctggatggcagtgagcccggaaaaactggtagtatccggtgtgaactgccgaggagtctacgactctgtccgggagatcgtagtagtatttccgggtagcgatatccagggaaagccgatccaggggatagccgggaactcgcttagaatgtggggtatctgtcaggagaaacggttctgtccatagggattcatctatactctgataaatatgttccggatcaaggataagacagatggcgtttttgtatcggccggtcagaagaccaccgtggattctggcaagattggcatagtatgccgtcatttcctcatcgttcagggagcgcccgccgacccggcggatgtgggttccaggctgaagatcaggtgaaagatctccaaagtacagtccactgtcgcaggaaaagacagggagatggaaggtgtcatagtacgtatgtgcttttaaaaccgcattttccaggggatcgtttccggtttcttctacctccggaatccgagtgttaagatcacgcagcccgatcatatcaatggaaagtttgtcaagtacttgtttcatggaagagagtttggcaggatttgtcgtaccgtataataatcgcatttgcttttacctcaaaaatcagaaaatatcaaaactcccggagaaggatgattccccggaagtctggtttggctgtatgttttcgtgttgtactatttttggttgtgtttttcttccatcagcttcatggcacgcactttcagcggcagtccgaacagattgatgaatccgtccgcatcgtggtggtcgtagagatcaccggttgtgaagcttgcgagggattcgctgtacagagagtatggggaggtcgttccggccttgataatattgcctttgtacagcttgaatttcacttctcctgtcacatactcctgtgtggatgttacaaaagcctggattgcctcccgaagcggtgtgaaccatttcccttcgtatacaacctgagccagcttattggcaaggtttttctttacttcgtgcgtcgcacggtcaagaacaagctcttcaagctgctggtgtgcttccatcaggattgttccgccaggtgtttcataaacgccgcgggatttcattccaacaacacggttttctacgatatcgatgataccaataccgtgtttgccgccaagactgttgagttctgtgatgatctcggacagtttcatctctttcccattcagactcttcggaatccctttttcaaatgtcatggtgacatcttccggctgatccggtgccttttccggcgtcacactgagcacaagcagatcatcgtagttcggagccagagaaggatcttccagttccagtccttcgtggctgatgtgccagaggttccggtcgcgactgtagctgtgttttgcgtcgaacggcaagtcaataccatgctgtttgcagtattcgatttcatcttcacgggactgcatggtccacagatcagtcattctccaaggagcgatgatcttaaggtccggagccagggcggtaataccaagctcaaaacggatttggtcgtttccttttccggttgcgccgtgacagattgctactgcgttttctttccttgcgatctcaacgagctttttcgcaattcccggacgagccattgctgtgccgagcagatatttgttctcatagacagcaccggcttgtacgcaaggcataatgtagtcttcgcagaactcatccacgatattttcaatgtagagcttgcttgcgccggacatctttgcgcgctcttccaatccgtccaattcttccccctgcccacagtcaatgcagcagcagatgacgtcgtagttaaatgtttctttcagccatggaatgacggctgtcgtatccaggcctcctgaatatgcgagtaccactttttctttcataatctatattcctcctgaatttgatgttccgattcacatgtgttactatacacctttttttataattatgcaatacataaatgcggaaattagaaaaatgggatgagattttttaatatagatgcataattcacaaaaaaatattcacgaaataagaataattatacaaaaaagatgcgtatttatacttgcgaaaggaaaaaacaggttgtatactaaagactacaagtaacattgctcgattccagaggagcgttctatatgattttatagaaagaaaggaacgaaaaatatgataaaagcaggaatcatcggggcgactggatatgccggaggagaactggtccggatcctgatgggtcacaaggacgtggaggtcaaatggtacggttccagaagctatatcgatcagaaatatgcggcagtataccagaatctgtttcagatagtagagggcgtctgcaaagatgataatatggaagaactggcgaatcaggtggatgtgatcttcacagcgacgccgcaggggtattgtgcttctttattaaaagaagagattttatccaaagttaaaatcattgatctaagtgcggacttccgtatcaaagaccagaaggtttatgaagagtggtacaagatcgagcacaaaagtccgcagtttttaccggaagcggtgtacggactgtgtgaaattaaccgggagaagatcaagggggcaagaattctggcaaatccgggatgttatccgacttgctcgattctttccatctatccgcttgccagagaaggattgatcgatatgaatacgctgattatcgacgcaaagtccggaacatccggagcgggaagaggagctaaggtagataatctttactgtgaggtcaatgaaaatatcaaggcttacggcgtagcgactcaccggcatacaccggagatcgaagagcagcttacccttgcgtctgggacaaagacggtactgaatttcacgcctcatcttgtaccgatgaatcggggcatccttgtgacggcatatgcttcattgaaaagagaagtttcctatgacaaggtaaaagagatttacgaccgttactatgcaggcgagcagtttgtccgggtactggaaaagggcgtctgcccgcagaccaaatgggtagagggaagtaactatgtagacgtaaatttccagattgatccgcgcacaggcagagtgattatgatgggggcgatggataatctggtgaaaggagcagcaggacaggcggtacagaatatgaacttgatgtttggacttccggagaaggaaggactgaatctggtgccgatgtttccataaaagaaagatgaagattcgagaaatgacaatcgaggattacgatcaggtctaccatctctggaaaacaatccacggattcggaattcgaagtattgacgactccagagaaggggtagagcggtttttgaagagaaatcctacatccagcgtagtggcagaagaggatggtaaaatcgtaggctgtattctctgtggacacgatgggagacggggctgtttttaccatgtctgtgttgaggagtcctaccgtaaacatggcatcggccggcagatggtgggggcgtccatgagggcgttgcaggcagaagggattaacaaggtgtccctcatcgcatttacgaagaacgatgtaggaaatgcgttttggaaccgtattggctggacgaagcgggaagatctgaattattacgattttactttgaatgaagaaaacatcactgtgtttattgaataatcatgttttagaaagaagaaagacgggaggacggcaagatgaagatagtagaaggtggagtgacaaaggcaaaaggctttgaggcggccagtaccgcggcgaagatcaaatacgagggcaggacagatatggcccttgtctacagtgaaataccgtgtgtggcggcggggacgtttacgacaaacgtggtcaaagcagctccggtcaggtgggacagacagcttgtagattccggcagaccggttcaggcggtcgttgtcaattccggaatcgccaatgcatgtaccggagaggaagggatgtactactgtgaagagaccgcaaaggcagcagcagcggcactgggaatcccggcggacagcgtagcccttggctccacaggagagatcggacgtcagcttccgattgaccgtatccgggcaggcgtggaagcgctagcccggaagaaggatgggacaatcgaaaatggtacattggcagccaaagcgattatgacgacagatacaacggaaaaagagctggcagcccagattgaggtgaatggaaagactgtgacgatcggcggtatggcaaaaggctccggaatgatccatccgaatatgtgtaccatgctcagttttattacgacagacgctgtgatctccaaagaggcattgcaaaaggcgctgagtgaggacgtgcagaatacttacaatatgatctccgtggatggagatacttccacaaacgacacagtgctgctcctggcaaacggtgcggcccaaaacgaagaaatcaaggtgggaacaccggactatgaagcgtttacagaagcgctccatgagatcaacgtctacctggcaaagaagatcgccggggacggagagggtgctaccgccctttttgaggcgaaagtgattggcgccaagacgaaagagcaggcaaaaacgctggcaaaatccatcgtctgctcagatctgacgaagactgccatcgcagggcacgacgccaactggggacggatcttctgcgctatgggttactccggagcacagtttgatccagagaaagtggatctgttctttgagagcagggcaggcaagattcagattacagaggacggcacggcagtaggctatagcgaggagaaggcgacggaaattctttcccagccggaaatcacagccattgccgatatcaagatggggacagaagaagcatccgcatggggatgcgatcttacatacgattatattaaaatcaatgcggactacagaagctaggaggtaggaaaaatggataagagtatgcagaagtatctggacaaggcggaagttctgatcgaagccctcccgtacatccagcggttcaaccggaaaatcatcgttgtcaaatacggcggaagcgccatgcttgacgaagagcaggaaaaaagagtcattcaggacgtcgtactgctgaagctctgcggattcaagccgattattgtacacggcggcggcaaggaaatcagtaagtgggtggacaaagtcggtaaggaaacaaagtttgtgaatggactccgtgtgacggacgaggagacgatggagatcgctgagatggtactttccaaagtcaacaaaaagcttgtacagcttgtagaagagcttggaatcaagtccattggtgtcagcggaattgatggaggtctgttaaaggtaacgaaaaaatatgtagatggcgaagacattggttatgtgggaagtgtctgcgacgtggagccgaagattctctttgatcttctggaaaaagactttcttccggttgtctgctctgttggtttggataacgatttccaggcatataatgtcaatgcggacgaggcggcctgtgcgattgccaaggcggtcaaggcagaaaagctggctttcttaacagatattgaaggtgtttataaagacccgaaagatcctgcgactttgattccggaactttcagcggaggatgcgatccgtctgattaacgacggctacatcgagggcggtatgctaccaaaacttagaagctgcatcgacgcgctggaaaacggagtttcaagaattcatatcctggacggacggattcctcattgtctgctgcttgagatcttcacgaacaagggaatcggtaccgcgattttaaatgacaaggagtgtcggtattatcatggataaagcatatatggaatcagtacagaacgctttggtgcacacttacaatccggctccgattgtgctcgatcatggagagggtgcctatctgtacgatacggaaggaaaagcgtatctggactttgcggccggttacgcagtcaattccttgggatacggaaatgaggaatggaatcaggccctgaaaagtcagatcgatcatctggcgcacacttccaacctgtactatcatacaaggacaaaagaggcggccgaagcgctgaaaagagtgtccggaatggatcgaattttcttctgcaacagcggtggagaggcaatcgagggagcattgaaggcttcacgaaagtatgcatacaccaaaaagagcggaagatatgagtggattgccatggaagagtcgttccacggacgtgggttcggcgctgtttcggtgaccggacataaggcgtatcaggaaccatttgagccgctcgttcctggagtgaggtttgcaaaatacaatgatctggaaagcgtcaaagagctcgttaccgataagacctgcgccatcattttggagccggtgcaaggcgaaggcggaatcaatgtcgctacagaggaatttttaacagggatccgccggatttgcgatgagaatgatattctgatgatctgtgacgaagtacagtgtggtatgggccggacaggctctttcttcgcttggcagcagtatggagtacggccggatattctgacgatggcaaaggcgattggaaatggatttccggtgggcgcctttgccctcacagagaaggtggcagagtgctcgctgaatccaggggaccatggtacaacatatgggggaggaccacttgcctgtgccgcagtcgcaaagactgtggagatctatgagcgcgagcatcttccggagcatactgcaaagattggcgcttatcttcgcaaacagcttgaaaatcttgcgggacgacacacctgcatcgtatcctgcaagggtaagggactcatgcagggaatacagctcagtatcccgcttgcagatgtgacaaaaaaggcgctggatcggggacttctgctgatcggtgcgggaagcgatgtgatccgttttgtaccacctctgattatcacggaaaaagaagtggatgaactgatccggattctcgacgagatcctggaatagtgaataaaaaccggtgtttcggggacactactttctcaaatggaaaggaggaatgaccagaaatgaccggttttatcattgccctgatttccggtgcgcttatgagtgtgcagggggtctttaatacccaggtaacgaagacgactggaatgtgggtcagcaatatgtgggtgcagttctctgctttcatcgtctgccttgttgtctggtttgtggcgggaagagatccgatcggaggaattctggaggtacagccacgctatatgctgctcggaggagcaatcggagcagggatcacctggactgttatcaaaagcatggaccagttagggccagccaaagcagcgcttctcattgtaatcgcccagcttattgtggcttatgtaatcgaacttctggggctttttggtgtggacaagacaccttttgactggaaacgggcaggaggtcttttgattgcacttattggaattgcaattttccaatggaaatagagttgtaatttaaagggaaattcgttacaatagaactatctgcatagagggggcttttctcatcgaagagaaaggagaactatgcaaagaaagagaaaaaagctgctctgcatgacggccgcggcagtctttgttttgtccgggctgtcgggctgtcacggaaaaggacaggatacggagggagcccctgtcgttttggaagatgcgtccggagaggacggcaaagaggcaaaggacggcggggtgagggatgccggagaggatgagcaaaaggagagtccgaaagaggcggcagattccatcgttgtctatgtctgcggaaaggtcaggaaggaaggggtcgtgacacttccggccggcagcaggatttaccaggcgattgagatggcaggggggatggcggacgacgctgcagcctcatatctgaatctggcggaggtgctgacggatggagcgagagtctatgtccctggaacagatgatgcagaagtggggaattcgagtattccgcagggaaacacggccggaggcttttcaggggagacagacggaaaggtaaacataaaccaggcttccaaagaggagctgatgacacttccgggaattggcgaagtcaaggcggatgcaatcattcagtaccggacagagcaggggaaatttgcttctattgaagagattaaaaatatttccggaatcaaggacggagtatttgaaaagatgaaagacaagataacagtgtagcgagggagaaacatggcaaaaagggtattggttgtagatgatgaaaaactgattgtaaaaggaatccgtttcagtctggagcaggatggcatggaagtggactgcgcctacgacggggaggaggccctttcctatgcgcgcgatcatgtttacgatatgattcttctggatattatgcttccgaagctggatggctttgaggtatgccaacagatccgggaattttcggatgtgccgatcgtcatgctgacggcaaagggagacgatatggataagatcctgggtctggaatatggggcggacgactatattacaaagccgttcaatatcctggaagtaaaagcaaggatcaaggcgattatgcggcggacaggcaggaaggaaaaggacacaaaagatacgaagatgattgtcaagggcgatctgaaactggactgcgagagcagaagagtattctcaaaagaccgggagatcaacctgacggcaaaagagtttgatcttctggagcttctggcccacaatccgaacaaggtttactccagggaagatcttctgaatctggtctggggctatgagtatccgggcgacgcgcgaaccgtggatgtacatatcagaagacttcgggagaagatcgaggtgaatccaagcgatccgaaatatgtatatacaaaatggggagttggttactattttagggggtaagctaaaactcaggcgccatccgttcaaaagtctcagggtgttgatcttcctgctgatcctttttgtaggtatggtgccgtgtctgattatacggggtgtggttcttcgttccaacgagagctactccgtgtctatccgcatggcagagattcagaatcagtgtacgattctctgcaaccagctctcggtgctggatacgctgaccggggatatacctgagtcgatcgatgcggagatcacacagttttccaatatttataatgggcgtgttatgattattgaccagtcctatcagatcatcgaggattcttacgatcaggacgtgggtaagacgattgtctccggcaatgtcatcaagtgtctcagaggcgagtctatcagtaactatgatgagcgcaacagttatatcgaggtgacggctccgatccgggtgacggcgtccaaagatatcgtgggcgtgatgctggcaagcgtttccaccgataatattgtcggaatccaggagaatttaaaacagacgatggatattattattcttacagctcttgttgtgctgattgtgtccggtattctggtaagtttttatattacgaggccactgaaccggattacgaaatccgtggaaagtatgacggagagttcggagggaaacgagctgcatgaatatgcttttctggagaccattcggttttcggaggcgtttaacaagctgatcggaagattcaaggtactggatgagacaaggcaggagtttgtctcgaatgtgtcccatgagctgaagacgcctttgacatccatgaaggtgctggcagattctcttctgtcccaggaggaagtcccggcggagctttaccgggaatttatgggagatatgtccgaggaaatcgagcgggagaacaagatcatcaatgatctgctttcgctggtaaagatggacaagacgtcccatgatatgaatattgagacactggatatcaaccaaattgtggagcggattttaaagagacttcgtccgattgcccagaagcagaatatcgagcttgtatttgagacatttcgtactgtagaggcggaagtggacgagacaaagttatctcttgcggtgagcaatctggtggagaacgcgatcaagtacaatcataaaaacggctgggtacatgtgtcattgaatgcagaccataagtttttctatttgaaagtggcggattccgggatggggataccaaaggaatcccaggagcatatttttgaacggttctaccgtgtggacaagtcccattcccgtgagatcggaggtaccggacttggtcttgccattacgagaagcgccgttgtcatgcaccggggggccatcaaggtatacagtgaggaaggagaaggtacgactttcaccgtgcggatcccgctgaagtatgttgcaagtacgaactagaaggaggagaccatgaaaagaaagaaggatgtatcatttctgcttgtcctgcttctggcttttggtctgctgtccggatgcgggagaggagagcaggtcaagcagagtgggtttgggctgtactatctgagtgctgataagactgatcttgtcaaggtgtccgctgaaaaagagggaaagacaaaggaagagcagataaagcatgttctggatgttctccaaaagccaaaggaggagtctgaggattatcagagtccgttcataaaggatgtaagtgtgaaggagttcgaggtggatggaaagcaggtagatttgtcgttcaatgagaagtaccgttctcttgacacgactgaggaggtactcttacgggcagcagtcgtaaagagcctggtacagatttccggtatccagtatgtttccttttatattgagcgggagccgcttctgaggtcagataagatgccggtcggcctgatgagttctgaggatttcgttcagaatgtcggatcctcgctgcatttttatcaatccacatcactgacactttattttgccaacaaagccggagacggactcgtaaaagaaacggtcaataatgtacgttataacagtaatatatcgatggaacggctggtgatcgaacagcttctgaaaggtccgtcttcttcaggagcgtatgagacgttaccggccaacaccaagattttgagtgtttctacaaaggatcagatctgctacgtcaattttgaccaggaactgatgaatatgaagtccaacgttaagccggagattctgatctactccattgtcaattcgattgtggagagcggaacggcaggacaggtgcagatttccatcaacggcgagagcgatatccgttttggacagagcgtacctctggaccagccgctttcgcgtaatctggatcttgtggaaggagaaggaaaagattgaaaaacaggcctctggtgatgatatgccttgtttttctgatgattcggtatgtgatcttctgggtgggagcaaaggaagagctcccgcccgaagtcctacggatggatggggagaccgtccgggtgaccggacagatttacaaaagagagcaaagagaaaaaggtccgacatggtatctccgttcagaagacagaggctacattgtctacagctccacatggagcggttataagatcggcaatacgatcacagtcacaggaacctttcagttgtttgaaaggccgtccaatccgggagcgtttgactcccgttcttactatctaaatcaaaagatctgcggaagaatccttccggaatcaatcgaagtcaatgatacgacaatacaatatggaaaagaatggcttgcccgtctgcgggaacagtggaaagacgagctcctgacccggatgggagatgaaggagcagtgcttagtggaatccttctcggagataagagcggactggaaccggagacgaaagagctctatcagaagaacgggatcgcccatctgctggcagtgtccggtctgcatgtgtcctttatcggtctgatgctctatcgtttgatgagaaaagcaggagcaccatttttggcgggagctcttgtcggaacactgatattatttccctatgcggtgatgacaggattcagtgtttcagcaaaacgggcagtgctgatgtatctgatacggatgggagccgaggtgagcgggcgggtttacgaccttctgacaagccttgccgtctcagcggcgattctcctgggagctcatccgcgctcggtgtatgatgtgggatttcttctttcctttggggcgatctttgctatctgggcaggggagactctgtggatacatctgaccggaaaggaaaagaaagggttccatgggaagtttctggcggccatttggccgggaatttgtatccagttgctgacatttccggtgctgcttacatcctattttgaatttccgctctattccgtgctgatcaatctctgggtgattcccctgatgtccgttgttatgggtgcggggctgctggggagtctgtgctgtcttatcctgccgccgttcgcgacggtatttctgtggatcagtaagctggtactttgtttttacgagtggaactgccagatcatgctccagcttcccgcggccagggtcattaccggggaaccgggatgggtgcggatctgttgttacctggcatttttgatccttgcctatgccttgtgctggaagaaaaagagaaagcttgggacaggatttcttctggttggactttgctgtcttctgggaccgtgcaatcagcatcgcggcgaactagagatcaccatggtggatgtagggcagggagatggaatcttcttccggatgcctggaggatggacctgccttgtagacggaggaagtacttccgggcaggatcttgcccgctatactctggaaccgtttctaaaaagccggggcgtggggacactggattatgtgttcatctcccacggggacgccgatcacatcagcggtgtgcaagagatgatcgagagggggagactgggagttccaatcaagaccctctttctgccagagaaacggctgtgggatgagggactgaatggacttgcccgaacggcaagaaagaacggcgtccgggtacaatgtataaagccggggatggcagtaagagatgaaaagggagcggttgtgtcctgcctgggaccgtcagaagcgtaccagggggagcccggaaatgaggcttccatgatcctgaagcttgagtatcagcggttttccatgctttttaccggggatctggaaggggccggagagcaggattttttatccggggcatacgcaaacgggatatacacagtgctgaaaacagcacaccacggctccgatggtgctacgacggatcagtttctcgaacagaatcatgcggacgtggcgctcatttccgctgggaaagacaatccgtacggacatccgggagaaaaactcatcaagcggctgaaaaaagcggatatgaaaattttttgcacaaaggataccggggcggtgacgatccgaagtgacggaaagcagatgtggattgagcgcttttctggcgcaggagggaacgaaacaggataggacaggatcatcaaagagcatgatgaaatcggactcggaaaattttcagatagggtgtttacggaaaaacacgttctatgctagaatagcgttatgaaaagtttaaatgaagatctcaaaacaggacaattcaaacaggtatatcttttgtatggcgaagagagctatctgaaaaagcaatataaggataggctctctaaagctatgcttcccgaaggggatacaatgaactatgcatattatgagggaaaggggacggacgtaaagcaggtgatagacctggcggagacgctgccgttctttgcgccgcgccgcctcattgtcatggaggacacggggtttttcaaaagtgcctctccggagctttctgagtatatccgcagtatgccggagacggcgtgctttctttttgtcgagagcgaggtggacaagcgtggcaagctctacaaagcagtgaaagaaaaaggccggattgtggaaatgacaaggcaggacggcgctaccctgcagaaatgggtgctttctatgatccagaaggaaggaaagcagatcacgcagtccgcggtccggttctttctcaccaaggtcggtgacgatatggagaatattcacggagagctggagaaacttttttgctacacgatgggaaggacagagattactattcacgatatggaggagatctgtacgacacacattgataatcagatttttgagatgatccatgctgtagcagagaaaaggcaaaagcaggcgcttctatattattatgacctgcttgccttaaaggagccgccgatgcggattttatttctgatggtccggcagttccgcatcctaatggaagtctccgaaatgagcagacggggatacggcaaaaaggagatcagtgagcatgtgaaaatcccgccgtttgcggttggaaaatacctggcacaggcgcagaagttttcgatacgtaagcttcggcagatattggaaggctgtgcggggactgaagaagaagttaagacagggaagcttgccgacaccatggcggtagagcttctgattatgcaatacagtagttaaaatgagttgatgggaggaacttacattgtcagttattgatcaaaaacatatacggaatttctgcatcattgcacatattgatcacgggaaatcgactttggcggaccggatcattgaggagaccggacttctgacaagccgggagatgcagtcccaggttcttgataatatggagctggagagggagagaggcatcacaatcaaagcgcagacggttcgtaccgtctataaggcaaaggatggggaagaatatattttcaatctgatcgacacaccgggacatgtggactttaattatgaagtgtccagaagtcttgcggcctgcgacggggcgatccttgtggtggatgcggctcagggtgtggaggcacagacccttgccaacgtctatctggcgctggatcacgatttggacgttttcccggttatcaataaggtggatctgccaagtgcggaaccggaacgtgttatcgaggagatcgaggacgtgatcggcattgaggccacggatgcaccgcagatttccgccaagaccgggctgcatgtggatcaggtactcgaggagatcgtccacaagattcctgctccaaatggggatcctcaggtgccgctgcaggcgctgatctttgactctgtgtatgattcctacaaaggggtcattgtcttttgccggatcaaagagggaaccgtgaagaaaggaactaagattcagatgatggcgacaggcgccagggaagaagtcgtggaagtcggttatttcggcgcgggccgtttcattccatgtgaagagctgagtgcaggaatggtcggctacattacagccagtattaaaaatgtaaaagacgccagggtaggtgatacggtcacggatgcaaaccgtccatgcgaaaaaccgctgccgggatacaagaaagtcaatccaatggtatactgcgggatgtatccggcggacggcgccaagtacccggatcttcgggacgccctggagaagttacagttaaacgacgcttcccttcagtttgagccggagacgtccattgctctcggatttggattccggtgcggattcttaggacttttgcatctggagattatccaggaacggttggagcgggagtacaatctggatctcgtcaccaccgcaccgagcgtaatctacaaagtacacaagacgaacggagaagtgatcgaacttacgaatccttccaatctgccggagccaagtgagatcgagtacatggaagaaccaatggtaaaagcggaaatcatggtgacgtccgaattcatcggggccattatggatctttgccaggagcgaagaggagagtaccaagggatggaatatatcgaggcaaccagggcggtgcttcactatcatttgccgctgaatgaaattatttatgatttcttcgatgctttgaaatcccgctccagaggctatgcatcctttgactacgagatgcttggatatcagcagtcctctctagtaaagcttgacattcttgtcaataaagaagaggtagacgctctgtcctttattgtttttgaggggagtgcctacgacagaggccgcaggatgtgtgagaaactaaaagaagagatcccaagacagctctttgagattccgatccaggcggcaatcggcggcaagattattgccagagagacggtcaaggcattgagaaaggatgtcctcgcaaaatgctatggaggagatatttccagaaagagaaagctcctcgaaaagcagaaagaaggaaagaaacggatgcgtcaggtgggaaatgtagaaattccgcagaaagcatttatgagcgttctcaaactggacgataaatagtcagaattgttttgaagtgtagagagggacgtgttccgatgcatcggaacacgtccccaattcatcatatcaggagggaagcaaatggagtcaatattggttgtggaagatgacgcattgctaagagaggaactctgtgtgctgcttaggcagaatggatttgaggcgtcagcaccggatgatttttcggaaatcccaaggattgtagaggaaaagagtccggatctggtgcttctggatgtacagcttgggtcggtcaatgggattacgttgtgcgccaggatccgggaaacgtcggaagtaccggtgatttttctgacgggacgttcttctgcgatggatgagctggagtgcctgacccggggtggagatgactttatcgcgaagccataccaggctccggttcttcttgcccatatccgggcagtattaagaagatcaaagccgaagaaacaggaaaaggagcagctttgctgccagggagtacggctttttgtgccggaggcctgcctggaatacagggggcaaagggtggatctgaccaggaatgagttgaagattttgtactatttgttccggcatccgggggagattgtttcccgtggggatctgacagagtatctttgggatcaggacgtctttatcgacgataatgctctgagcgttcatatgacacggatccggaataagctatcagccctcggtgtggaccatatgattaaaacaaagagaggaatggggtatcaggtttgaatctcgcaaactatatcagagaccggctgcctggaattctgggacagatgacaggcatcgtattgttgtttttttatcttcttatcattggcgtggggaaagacgacgcgtcgcttattctgatcgtctggctgtctggtgtgttcatcttttatggggctgatttctggaaaagaaaacgatatttcgatgagctggaggagacgtttggggctcttgacgaaaagtatctgatcgcggaggttgcacagccagagtatcacttggaagatcagatctattttgatatgctccgccgttccaataaatctgtgatagagaagattcgggatctggagagtcagaagcaggagtacaaagagtatattgagacatggatccatgaggtaaaaacgccgctttccgtgttggagctgatgtgtgcgaatcaaaaagagctggattccagaaaggtgcggctcttggcggaacggcttgaccgggatgtggagatggctctttactatgcgagggcggatcaggtcagcaaggattaccggatccgggagatttcgcttgaacatacggtaagagaagcggtaaagcgacaaaaacagcttctgatttccaatgggatgtcggtagacatagactgtggggatgcgacagcattttgtgatgagaaatggattgaattcatactgggacagatgtttgccaatgcggtgaaatacaaaaagggagcgtgcggacatatccaggtcagcgcaagaaagaaacaggaggcggttcttcttatagtggaagacgacggaatcgggatccggcaggaggagatacggaggatctttgaaaagggatttaccgggacgaacgggaggacgcatgagcacgccaccgggatcggactgtatctttcccggaaactctgcgataagcttggaattgccataaaggcggaatcggaggaagggaaatttaccagattccttctgacatttcccaaagggacgtttctttcgaaactgtaagattggagaaaggaaaaccgataccgaaaggagaagatattctgtaaactggatctatcaaaaagacggggcataagcttcgtaagataaaggaggatacaggatggatacgatcatcaaagtatgtgatgtggaaaagttttacggcaataaagatacgatcacaaaagcagtcaaccggatcagttttgaagtggaaaagggagagttcaccgctattatgggagccagcggaagcggaaagaccactcttttgaatcttcttgctacggtggatcaggtgacgtccggtcatattttttatgacaatatggatatcacaacactgaaagaggaagaggtggcaaagttccgtaaggagaatctgggctttgtatttcaggattttaaccttctggatacgctgaccttagaagaaaatgtgattcttgccatgacacttcacaaaaagaaaaaacaggagatccagcagacagtagcgtcggtgatgagagctttagggatctgggagtacagaaagaaatttccctatcaggtttccggcgggcaaaagcaacgctgtgcctgtgccagagcacttgtcaatcatccgaagctgattcttgcggatgagccaaccggggcgctggattccaggtcggcccggatgcttctggaaactttccgaatgatgaatgtacagtttggagcaaccattctgatggtaacacacgatgccttttctgccagttattgtaagagaattctctttttgaaggatggtgcgattttccacgagctcaaccgtgggaagcaggacagacgtacgtttttgaatcagattctggatgtgctctcgctgacgggaggtgatctggatgttgagtaagctggcgtttcgtaatgtcagaaagacggttcgtgactatggggtgtatctaatcaccatgattcttgtcacggcactgatgtttgcctttcattctatgatgttttcgcctcagatcaaaaaactggctacggtggcgggagttatggaggcgatgatcgggattgcagcaggatttatcgtcctcattgtctcctggcttgtacgctatattgtggcgtttatgatggaaaaacggagccgggagtttggaatttatctcctcatcgggatgaacaaaaaacagatccgtaaaatctttatgaaggaaaatacgatttttggtctgcttgcctttgtaatcggaatggttccggggatctttctggaacaggttctgacctctgttttttatcatattttcggggaggaatacacgatccattttcatatggaactttccacgtttcttctgacaagcgggctttatgccggtacatatctgctggcactgtggcgggtgaaacggcggatgaaaaagatgaatatccgaaaatttatggatctggagaagaagaacgagggggatcaggcgccagtccggaaatggagacggatctttcttccgctgtcgatttgttatgtaatcgggtatggcgtgatcctttatacgcatcggatgcatatggtaaacgggatgattctttcggcagtactggtttttatgatttatctgttctttgaggggctggccgcctggttgttctggtatattgagcggggaggaaaaggcgtctataaaaaggacagattgtttttactgcgacagttggcgtccaaaatccattctatgaagtttacgatgggaacagtgacgattctgtttgcctgtgcggttcttggaacgagctgtgctatgatgctctacgattatcagaataaaatgatgacctatcagatgccgtttgacgtgctggtttttgcacaggatcctcaggagaccatgaaagaagacagggacgtcatcgaggagaaagcagaggtgaaagacctgtttacttatcatatttatcaaaatgggaaggatacagtaaacaggtatcttatggatcatttggaatatatgaagtgggagtttgactctgtaaggcgtgagaacaagcgggatgtgaagatgaatgtgcaggatgggatcgtggaggccatggcatcagaagcctattttcagatggatacctatatgaaagagagtgattataatcgcctgcggagcatgttgggttatgagccggtagccctttctgacggagagtactgtattcagacgaagccgagaatgaaaagatatctgaaacagttttccagagaaaatcaggtggaggccgcaggcagaacttattcgtgtcaggggatttacacggaggcgttcggacagaacggacataatggggcggattatgtgatcgtcttgccggatgaagcagccgcttccatggagccatactatacacttctggcggcagatctgaagggggaggctcctaaggggcttttggaagaactggaaagactggaaagccggcgggaacaaacgattatagaggaaaagattaaaacatatgggggaaagaaacaggcggaggaagcagaaaaatttatctggggcagtgggacggacgaagtgatctccatgacgactccggtgcttgtacagacagatctggaagaagagctgaattatttgctgactgctatcgcctatccgttgatctatgtggcggctgtctttgtctgtactgctctgacggtgcttgcggttcagcagttaagtgacgcgtctcgccaccgttaccggtatgatgtgctttccaagctgggggtgaaaaggggagagatcaaccggatcatccagaagcagcttttgtggtattatggaataccgattttgtttgcactggctcttggagctatgatcgttttgtttatgggagaacggttcgtcttatatacagggattgcttcccagatctgggcttatttcgcgggatcaaccgccgttctgatggtggttgtcctgttatatctggcggtgacttatacagggtttaaacgaaatgtcaatttaaaagggtaccggctgtaagccggaaaggagaccgggaggctgtctggaacgattcccggtctcattccttgcatttcctttttgtttcctgtaaagtagaagaagagtatgtaagacagaaatgaggataaacaatcatgaaagaacttgaactttatatccatattccattttgtgtcaggaaatgcgcttactgcgatttcctgtccggccctgccggggagccagagagggaagaatatctggaggcattagtaaaggagatccgaagcgcaggtgatatgggaagagggtgtcaggtatcaagtgtttttcttggcggagggacgccgtccatccttacgccggagcagatcggcgggattctttatgcggtgagggagactttcactctcgcgaaagatgcggagattacaatggagtataatccaggtacaggggagagcgaacgtatggcggactacttaaagatcggagtcaaccgtctgagtatcggcttacagtctgccgatgacggggaacttcgaatcctgggaagaatccacacctggaaagagtttctcaagacctatgaggaagccagaaaagccgggtgtgacaatatcaatatcgatttgatgtctgctattccggggcagactcttaatagttacgaaaggacgcttgagaagatatgccgtcttttgccggatcacgtttcagcctacagcctgattttggaggaggggacgccgtttggaaactggtatgaaaagtctcctcatccggcggggcatcccccgctgccggatgaggagacggagcgtcagatgtacgagcggacgaaagagatcctgcacggatatggctatgaacgatatgaaatttccaactatgcaaaagaagggaaaatgtgccgccataatatcggctactggaagcgggttccgtatttgggatttggtgtgggagcggcttcactctggaaggaaaagcgatggagcaacattcgagaccggaggcagtatgtggcgctttggaaagaacataagccgcgggaagcgtcccggatgatcagggagaacatgcagatgatctcagttcgggaagcgcaggaagagacattcttcctgggacttcggatgatggaaggagtttcggaatctcggtttgaggatacttttggctgcgccatagaggatgtttacggaaaagagctgaaaaagttagaagcggacggtctcgttcaaagagaaggcggaaagatttttctcacggatcgggggatcgatatcagtaatacggtgatgacatggtttttacaggatgaggaggaagaggaatgatctatttgattttggcgattctttgtagtgcaggagtctccatctttatgcgtgcgagcgagaaatactgtcaggggcattatggtatcttgctgatgaattatgttgtgtgtgtgctggcaggacttatcctcaccgggcgggggctgacgcagacagacggaaaagggatgccggtgacgatcgtgtttggtgtggtaacagggcttctatactgtggctcctttattctgcttcagtggaatgtacggaaaaacggggtcattctttcatctacttttatgaaacttggcgtcatcgttccggctgttttggcggtcgtctggtttggagaacgcccggggtggaaccagggacttggttttatccttgcgattacagcgattttgatgatccatcttgagaagggaaagatcaggactgaaaaagcatatacgataggacttctccttctgctgcttggaggagggcttggagactccatggcgaagttttatgatgtgtatgggaatccggggcttgggagcttctttttaatgctgtcattcctcgtgtccggaatcatcagtgggattctggtctttcgtggcggagagaagatcacaaagtacgaagtgctttttggcgttctgatcggaattccgaactacttttccgcccggtttcttttgtgggcgctggcagacatcccggcagttatcacatatccgacgtacagtatcgctgccatggctttgatcggcgcggcgggcgtcctgatgttccgggagaagctgacaaagagacagtggggggcgtatctccttgtgattcttgctgtcgggttgttaaatatgtagagaatagaaaatgcaggactgaatcgttacgatgttgcaaaaaaagatgaagaatcagtgttgacaaatgtgcgggagagtgctaaattagtaaacgtagatattagcactcggaataatcgagtgctaataagacggaaggaggcaccacatggaattcatccgggaactgaatgaaagaaaactaaagattttaaaagcagtcattcagaactacctggagacaggagagcctgttggttccaggacgatttccaagtatacggatctgaatttgagttccgctactatacggaatgagatggcagatctggaagagcttgggtatattgtacagcctcacacatccgcgggacggattccgtcggacaaaggatatcggctttatgtcgatatgctgatgcaggataaggagcaggaagtaacggagatcaaagagcagatgcttgagaaagctgataagatggatcagcttttaaagcaggcggcgagagtgctggcaaacagtacgaattatgctaccatggtttcagccccggtcagcgcgaagaaccggctgaagttcattcagctctctcaggtagacgaagagcagttgattgcggtgattgttctggaaggcaatattgtgaagaaccagatcttaaaggtggacgaggagcttgacagcgagacacttctgaagttgaatatgcttctgaatacgacgctcaatggaatggcgatcgatcagatcaccctggggctcatcgcaaagctcaaagagcaggccggtattcacagtggagtcatcagcgatgtgctggacgcggtggccaatgtgattcagcttgagcaggatatggagatctacacaagcggagcgaccaatattttccgttatccggaattatccgataagcaaagcgcacaggaaatcatcagtgcctttgaggaaaagcagcagctttcagagcttgtaacccagacgttgtcaagcgacagcaagggcatacaggtgtatatcggaaatgaaacaccggtacagaatatgaaagattgtagtgttgtgacggctacctacgaattaggcgaaggaatgcagggaacgataggaattatcggaccgaaacgtatggactacgagcgcgtcatggatacattgaaaacattacagaccgagctggatacgatatttcacaaaaaagaatagagcaaaagcagaaaggtggtatcctggtgggagacagtaagaatcaggaagaaatggtaaaagaagccgtagaggaagcaaaaaaacaggcttcggaaagcggagaggttccggcagaggaagaggtaaagagttctgagtccgaagagcaggaagcctcagatggccaggagcaggaagcttcaaacgacggcaaggaaaagaaaggattcttcaagaaaaagaataaaaaggatccgaaagatgaaaaaatcgaagatctgaccgataagctgacgcgccagatggcggagttcgacaattatagaaagcgtacagaaaaagaaaaatcggccatgtatgagattggggcaaaggacatcattgagaagatcctccctgtgatcgataatttcgagagagggttccaaagtgtcgaggacgggaaaaaagatgatccgttcgtagacggcatggataaagtatataaacagctaatgaagacgctggaagacgccggtgtcaagcagatcgaggccctgggcgaggagtttaatccggagttccacaatgcggtgatgcatgtggaagacgatgaagcaggtgaaaatatcatcgtggaggagttccagaaagggtatctgtaccgtgacagtgttgtgagacacagtatggtaaaagtagcaaactaacaaattttatgaaataaatcaggaggaaattcattatgggcaaaatcattggtattgacttaggtacaacaaacagttgtgttgccgtgatggaaggtggacagccgaccgtcatcgcaaatacagaaggcgcaagaacaacgccgtctgttgtggcatttacaaagacaggagagcgtctcgtaggtgagcctgcaaagcgtcaggctgttacaaacgcagacaagacgatctcttccatcaagagaaaaatgggtacaaatgagaaagtaaatattgacggaaagatgtactccccacaggagatttccgcgatgatccttcagaaattaaaagcagacgcagaaggatacctgggtgaaaaagtgacagaagcagtcatcacggttcctgcttacttcaacgacgcacagcgtcaggcaacaaaggatgccggcaagattgcgggtctggatgtaaagcgtattatcaatgagcctacggcagcggcgcttgcctatggacttgacaatgaaaaagagcagaagatcatggtatacgatttaggaggcggtactttcgacgtttccatcatcgatatcggggacggtgtcatcgaagtactttccacagccggaaacaaccagctcggtggtgacgacttcgaccagaagatcacagactatatgctggctgacttcaaggcaaaagaaggcgtagatctttctaatgacaagatggcgttacagagattaaaagaagcggcagaaaaagcaaagaaggagctttcttccgcaacaacaacaaacatcaaccttccgttcatcactgcgacagcagaaggaccgaagcactttgatatggatctgacaagagccaaattcgatgagcttacaagcgacctcgtagaaaagacagcagagccggtacaaagagcactttccgacgcaggacttcgtccgtctgatcttggccaggtacttctggtaggtggatctacccgtatcccggcagttcaggacaaggtaagacagcttacaggaaaagagcctagcaaatccttaaatccggatgaatgtgtagcgcttggtgcttctattcagggcggtaagctttccggagaagcaggcgcaggcgatatccttcttttggatgttacaccactttctctttctattgaaacgatgggcggcgtagctacaagactgatcgagagaaatacaacgattccgacgaagaagagccagatcttctccacagcagcagacaatcagacagccgtagatatcaatgtcgtgcagggtgagagacagttcgcaagagataataagtctctcggacagttccggctggatggaattccgccggcaccacgtggaatcccgcagatcgaggttacgttcgatatcgacgccaacggtattgtaaatgtttctgcaaaagatcttggaacaggcaaagagcagcacattacgatcacagcaggttccaatatgtctgacgacgatatcgacagagcagtgaaagaagcggcagagtttgaagcagcagataagaagagaaaagaagcagttgatacaaagaacgaagcagatgcgatcgttttccagacagaaaaggcattaaaggatgttggggataagatcgacgcagccggaaaatccgcggtagaagctgatattcaggcactcaaagacatccttgcaaaatatccgaacgcggaagagatgacagacgctcagatcgctgagatcaaggcggcaagagagaaattgatgacaagttctcagcagctcttcacgaagatgtatgagcaggccaatccacagggcggcccacagggagcaggtccgcaggacagtgctcagtccggaccggcgccggaaggatatgacgacgtcgtagatggagactataaagaagtataatccggtacggtaaaataagaaaagcagagattgcgcgcggcgcaatctctgtgcgtgtgtagattcccggttggatattgaatctgacaccggcagacagaacatgcggcagcgtctactgtatagaaagggaaggtaacgattatggcagaggcaaagagagactactatgaagtcctgggagtatccagagatgccgatgacgcaacactgaaaaaagcataccgtcagcttgcgaaaaaatatcatccggatatgaatccaggagatgcggaagcagagagaaaattcaaggaggcttctgaggcgtatgctgtattaagtgatccggataaacgtcgccagtatgaccagtttggacatgcggcatttgaaggtggcggagcaggcggtgcaggcggatttggcggctttgatttcagcggagcagatttcagcgatatctttggcgatattttcggagactttttcggtggaggaagaagaggaggcagaacgaataatggccctatgaaaggtatgaatatccggaaaggaatccggatcacctttgaggaggcggtattcggctgtgagaaagagattgatattatcttaaaagatccatgtgaaaaatgtcatggaacaggggcaaaaccgggaaccagcccggagacctgtccgagatgcggaggtaagggacaggtggtttacacatcccagtccttctttggaacggtacaaaacgtacagacctgtccggactgccatggctccggaacgatcatcaaagacaaatgtccggactgtgcaggaaccggatatgtttccaataagaagacaattcaggtatccattccggccggaattgacaatggccagagcgtgagaatacgggataaaggagagccgggaacgaatggcggcccaaggggcgacctcctcgtggaagtaaccgtgtccagacatccgattttccagagacaggatatgaatattttctccacagcgccgatttcttttgcgcaggcagcccttggtggtgatgtccgtatcaagacggtggatggagaagtcgtctatacggtaaaaccgggcacaaagactgacacgaaagtaagactccgtggtaaaggcgtaccgtctgttcggaatccgaaagtacgtggggatcagtacgtcacgctcgttatccagacaccggagaaattaagccaggaggcgaaagaagcactcaaacgtttcgacgcactcgctggaaattccctgaatcagccggaaccggagaaggaaaagccgaagaaaaaaggctttatggacaaattaaaagagacctttgaagaaagggacgaataaagaagcaaaaggggaacagattcgattacaaaggagatgttcctcttttttattttgccctgttgacaggggcaggaaatacaggtatagtaaaaacagatatatgaatggttgttcatatgttctggagagcagtcaaaaaggagatggggcaatatgctgaaagtagaacacctttcttatgaaatagaagaagatgggaagaaacaggaaatattaaaagacgtcagctttgaagtggcggatggggagatgcttgtcgtgaccggaccaaacggaggaggcaaatctaccattgccaagctgatgatgggactttatcacgcaacagaagggaagattttcctggacggggaggatatcaccaagtgtaccatttatgatcgggcaaaggcaggaatcggctttgcttttcagcagccgccgcggtttaaagggatgacaatacgaaggcttctgtccctggcggcaggaaccgagcttccgaagcacatctgctgcggacttttgagccgggtaggactctgtgcagaggaatatttggatcgggaagtagacgctaccctttccggaggggagatgaaaaggattgagattgccacggtgcttgtgaagaaacataagctttgcatctttgacgaaccggaggcaggaatcgatctctggagttttgctatgttagtggaggagttcaaaaagcttcacacggagaaaaaggaaggcctgcttttgatttctcatcaggagcgtattatccgtatggcggatcgtgtcatgattatcgaaggcgggcaggtgacaaaatgcggaccgacagaggagattctgccatatctgaccggagaggcaatcagctatccacagtgtctgagtcatcgggacgctgcgttataagaaggaagaaggtgcgagaaatgatactggataaaattacagaaaaagtacttcatatgatcgacggagaaggatttaaacaggagggagctttcaatctccgggaaaacggaatcgccgtctgccacggggacagtgagcatgtcaagatccgtaaaaaagaagacaagcagggaattgacatttatattgacaagaatacaaatggggagacggtacacattccggtggttgtctccgcctccggaatgaccgacgttgtctacaatgatttttatattgaagatggggcgaatgtgaatatcattgccggatgcggtatccataattcgggatgcaacgatgcaaggcacgacgggattcacacatttcatattggcaaggatgccattgtccattatgaggagaaacattacggggaaggagaaggtacgggagccaggattctgaatccggtaacagatatttatgtaggggagaattcggtgtttactatggatacggtgcagatcgaaggtgtagattccacgaagcgtgagaccgacattaccatggaggcaggaagccgtctcacagtgacagaaaagctgatgacccatgaccgccaggaggcagtttccaatatgaaagtgatcatggacggcgatggaagctcggcgcagatcatttcccggtctgtggcaaagggcgagtctatccagactttccacccacgggcgatcggaaagacagcctgccatgcgcacatccagtgtgattctatcattatgaatgatgcacaggtgcgttccattcctgagattgacgccagaaatgtggacgctcagatcattcacgaggcggccattggaaggatcaacagtgaacagcttttgaaacttgaaaccttcgggctgaatgaggaagaggcggagggagtcatcattgaaaacttcctgaattaaaatagaagcaggattctcaggtaactggaacatttcataaagtttgggggatgtctcatcccccaaagaggaaaagaaatcccccatttcaaaaactgcatagtttcatttgatctgaagatcagattttgacgtccttgatatccataatctccttatgactgtatacatgctgctttaatgcttcgaagctttccgggctgatgacatgctcgatccggcaggcatcctgagtggcagtctccttagaaacgccaagatacataagaaagctggaaagcaaagtgtgacgctcgtaaatcgtctcggcgatctcatgtcccttttccgtcagtgcgataaagccatctttatccatcaaaatatatccgttctctcgaagattcttcatggcgacgctgacgcttggcttggaaaaagaaagtgcggttgcaatgtcgatagagcggacatttccctttgcttttccgagcatcaggatggtttccagatagttttcagcggattcctgtattttcatcagaatgtctccttccatatatagtgtccttaaagacaaggataacatatttgtagtgatagttcaaacacttctggagaacgaggaggagaaaaggcagaggaaatatgatacaatagtgggaaaagagacaataaaggaggacatattcatgcagaaatttacctattgtgtgccgacagagattatttttggaaaagataccgagagggaatgtgggaaaatggtgaaacggcatgggggaaagaaggtgctgattgtctatggaggaggcagcgtcaggcattccgggcttctggagcgggtggaacactcccttgaggaggaggggatttcctatgtagagtgtggaggcgtgacacccaatccgagactttcttttgctgagatgggagtaaagaaagggatcgaagagggtgtagattttattctggccgtgggcggcggaagcactatcgatgcggcgaaagccatcgctcacgggactgcgaatccgggtgtttcgctttgggatatctggacgaagaaagaatctcttaccaaaacattaaaggttggcgccgtattgaccatctcggcagcaggaagcgagacgagcgactctgccgttttgaccaatgaggcaacaggaaagaagcttggtctggggacagagctgaaccgacctgtttttgcaatcatgaatccggagcttacctatacgctcccgaaataccagattggatgtgggatagcggacattatgatgcacactctggagcggtatttcattccggatcagaaaaacagaatgacagacgaaattgcggaaggactgcttcggacggttattgacagcggaaggatggcaatgaagcgctcggatgattacgatgccatgagtgaattgatgtggtgcggaagcctttcccataataatctgactggattgggtcgggagaaggatttctctgttcacaagctgggacatgccctgagcgcccggtttgattgcgcccatggcgctacccttgcatctgtctggggagcctgggcatggtatgtctgggaacgggacattgcccgtttcgcgcattacgcaaaacaggtatggggcatcgaaagagatgagatatcagcggcaaaagaagggatcgagcgtacgatcgcttactttgaggagattggaatgccgacttccatttccgggcttggtatcggtgttttggaggatgagacactgaaagaactggctcttgacgctaccatgaatgataccgtccgtctttcgctcatccgcccactctctgcggaagacgtgctggaaattttccgcaaagcaaattactaggaattgccaaaccgggcgcaaaggtggtatactaaaacaagatgcagtcaataactgtaaatatcgataagaggagtgacaaacatgaaagtagtagcaacagaaaaggcaccaaaagcattaggaccatattctcagggatatgtttccggaggcgtattttactctgcgggacagattccggtaaatccggcaacggatgcggtagaggctgataccatcgagggtcaggcagaacaggcatgtaagaatgtcggggaagtattaaaggcagcagggacagattttgaccatgtagtaaagacgacctgcttcttaagtgatatgggagattttgccgcgtttaacgaagtgtacgcaaaatacttcacatctaaaccggcgagaagctgcgtggcagtgaaggcgcttccaaagaacgtactctgcgagatcgaagtgattgcggcagtagaggaataggagcaacaaaaatggcagaagaaaagaaacaggaaggatgtccttccgagggctgtgccggatgctcccatgcatccagatgtaccagccagatgaaggatttcagaaagccggcgaatccgtattcggcggtcagaaaagtcattggagtgatcagtggcaaaggcggcgtaggcaaatccatggtgacggcttctcttgcaagaatgatgattgagaaaggatatacagcaggaatcctggatgcggatattacaggaccgtccatcccgaaaatgtacggcatccacgagcaggcccttggtaatgaagaggggatgctcccatgtgtcgcaaaagacggtacgaagattatgtccgtgaatctgctcctggaaaaagaggatactccggtcatatggcgcgggccgattattgccggtgtagtgacacagttttggaccgacgttatgtggggcgatgtagattatctttttgtggacatgcctcctgggacaggagatgttccgcttacggtatttcagtctcttccggtggacggtgttgtgatcgtgacgtccccgcaggatcttgtcagcatgattgtaaagaaagcctaccatatggcgaaagatatggatatcccggtgcttggtatcgtggagaatttcagttaccttaagtgtccggactgtggcagaaagatcgaagtctttggaaagagtcgcatcggggagatcgcaaaggagctggatattccggtgcttgggcggatcccgatcgacccgaagctgactgaagcggtagacggcgaggcgtttgaccaggtgaagaatgtatacctggacgatgcggcaaaggtattggaagtatgatggattattcacttttgaaagaacagatggatgcgctgaccggaacgcagagccgcccgattccaaatctggcgaatgcatccgctctgatctggcagatgcttggtgatattaactgggccggattttatctgatggaaagagataccctctatcttggcccgttccagggaaaaccggcctgtatccggatccctttgggtcagggggtgtgcggaaacgcagcgcagaaagatcagatactcagagtatatgacgtacacgaatttgaagggcacatcgcatgtgacagtgcctccaggtcagaaattgtgcttccggttcacagcgatggaagtgtcattgctgttttggatatcgacagtcctctgacgggaaggttttctcaggaggatgaggatggattacgcgaaattgtcaaagtgctggagagaaactgtatatggaaataatataactctgtgtggagggaaagatcctctgcacagagttttttacttgcacaaatcgaacatgtgtgctatgataagaaaaagaacatatgttctaaaagaaaagaggagaagagatggagacctttcggattcagaaagaaaagacattatatgagaagctgagtattctttccgacgcggccaagtatgatgtagcctgtacgtccagtggcataaagcgaagcggagacgggacagggatcggcaactgcgagcaggccgggatctgccacagtttcactcctgacggcaggtgcgtttccttgttgaagattctctttaccaacgagtgtatttttgactgcaagtactgtatcaaccgtgtgtccaatgatgtggagaggacgtcctttactccggatgagatctgccgtctggtgatcgagttctaccggaggaattatatcgaggggctgttcttaagttccggtgtctggaagagcccggattacacgatgcgcctgatctatgagacgctgctgcggcttcggagggaatatcggtttcagggatatattcatgtgaaggcgattcctggagcctcccaggatctgatccgaatgactggatttctggcagacaggatgagtgtcaatgtggaacttcctacagcagagagtcttcatcggctggcgccgcacaagagccgaaagaatattctggctcccatgcgttatgtccagaagaagagagaagagaacagccaggagctcgcgctctatcgccatgctccaagatttgtcccggcggggcagagcacccagatgattattggggcgacgccggaaagtgattatcagatcatgcgggtggcggagtcgctgtatcagaagtttgagttgaagagggtcttctactcggcattcgtccatgtcaatgaggactccgccctcccatccaggacagatgcaggacctccgcttctgagggagcacagactgtaccaggcggactggcttttgcgttattatcacttctcggcttctgagcttttgtcggaaaagcggccgaatttcaatcttgttctggatccgaagtgcgattgggcgctggggcatctggagtattttccggtggaagtaaaccgggcagactaccggacactgctcagggtgcctgggatcggatatacttcggccagacgcattgtacgggcgagaaagatgggatctctggatttcccggatctgaaaaagatgggagtcgtattaaagcgtgctctttactttgtgacatgcaaggggaagatgatgtatccgacgcgcatggaggaggattatatcctgagaaatctgctggaccccagagagaatctgccaagggggatgaaggagatcagttacaggcagatgtcttttttcgacgatgggaaggaggaatggatgatccgatgaagcgtagatatatttgtaccgatacgacgacagggattctttccgccatttatgatgcctggaaatatgacagaagcgatcaggaggcagggatcgtattttgggggaacatgcagcaggagatgttctgcgagtactgcgaggtgaaagagagtgaagagaaagcaagagctgtcagaaagctgatccggggacatctgggtgaggaggcgtatctggacatcggatacgccctcctctctggagatccggggaaagggactgctattcttggcatgatgatggaggcacggtcgcttcctgatggatacaggatcatgggacatctctcccatccggcagtgcggacagtgtttgagcttagcagggcggtgggccgggaaatccatgcatggaaagagttcctgcgtttccgggaactggagggtggaattctctatgcccgcattaccccgaagaactttgtactgcccggaattgcaggccattttgcggatcggtttccgttggaggattacgttgtttacgatgagccccattcctcggttctcattcatccgagacagaagcagtggctgattgtcaaggacgaggaaagaaagtgggaaataccaaaggcgtattccggtgaagaggaagaatggcagagactatggaagagatttaaaaagcgcgtgacgatcgaggagcggaagaatctcaagctccagcagacacatctgccgttgcgttaccggggagatatgccggagtttcattaagaagaaaagagccataggagcaatgaaaaagaggagagaatcttgagcgttttcgacaaagaaagtggaaaatgaaggaaaatatcggtatttttacagattgattttcaaaaaggatgatggcataatacttgagaacacagaagggagtgaaatcaatggagcataagcgtaaaatcagattaacccctgccgatgtccacgagtttgttacatccgcagagaaatgcgattttgatattgatgtgttttacaatcgattcaccgtggacgccaaatcgattttaggagtattcagtcttgatctgaacagaactctgactgtgcagtatgcaggaatcgacccgcattttgaagcaacattgaataaattctgcgtcgcttaagcgatcgggcagtagggtatacgaaaagagaggctctttctcttcgctggacggagagaaggggcttctttttttctgaaagatggtataataacgaggaaagtgcgggttgtgcttgcacaaaaccgcaattgacgagtaactccatcgaaccgcagttgagatggtataatgagagttgacgagccatgataaaatagaaaaagataagaaaaaaggcggagccggtaatggaagaaaaaaaagaagtacaagaaatacaggaagaagttgtccggatttcggtccgaaaccttgtagaatttatattaagagagggggatctggacaaccgacagggtggaaccgcggatcgggaggctatgctgcttggcgggcggattcaccgaaagattcaaaggcagatgggaagcggatatcatgcggaagtgcctttgcagatgatggtgccctgtgagaaattgaagattgtcgtggaggggcgggctgacgggattatcgaggagaaagacaggattgcgatcgatgagatcaagggcgtcctgatggatctggaaatggtcaaagaacctaagatggtacatttggctcaggccaagtgttatgcatgtatttatgcaaagaaaaggaatcttgatgagatcggggtacagatgacttactgtcagatggagacagaggaagtgaagcggttttaccagacgtatggctgtacagagctggagaaatggttcttgaaccttgttcatcagtatgagaagtgggcgctgttccagatcgaatggaggaagaagcgcaacgcctccattcgccgggtggagtttccatttccttatcgggaagggcagaaagatctggtggtgtcagtttaccgttccattttgagaaagaaaaagctctttatccaggcgccgacaggagtagggaagaccattgcttctgtgtttcccgcggtgaaagctgtcggggagggacttgccaatcagatcttctacctgactgcaaagacaattacaaggacagtggcggagaaggcttttcttaccttgaaagagcaagggctctcctacaaggtcattactctgacagcgaaggaaaagatctgtttctgtgagaagaccgagtgtaatccggatgcctgcatctacgccaaggggcattttgaccgggtcaacgatgcggtctttgacatgctcacccatgttgatgatatgagccgggatcagatcgaggcatatgccagaaagcatacggtctgtccttttgagatggcgctggatctctcggtttggatggatgcggtgatctgcgattataactacgtcttcgatcctaacgcccatctgaagcggtttttcggggagggggcgaagaaggaatatctgtttctgattgatgaagcccacaatcttgtggagagaggacgttccatgtacagtgcgtctctttgtaaggagcatctcctggaagtccgcaagattgtcaaaacagaggatgcgaaactgacaaaagcattatcgggttgtaatgagcagcttttgatactgaagcgggagtgtccggggcatgcgctctattcgagcgtttcccatctggtgatccggctaatgaatgtgatgagtgaggtggagcggtttttggaggagtgccggaaggaagaaatcagggagcaggtgctggatttgtattttgagatccgggattttctatccatccatgaaaagctggatgagaattatatgatctacacggagcttacagaggatggggggttttatgtccggctgttctgtgtcaatccggcggtcaatctcagcgaatatctgaattatggggtatgcactgtctttttttcggcgacactcctgcccatacagtattataagaagcttctgagcactcagacggatgattatgctgtctacgcccacacaccatttccagaggaaaatcggcgggtaatgattgggacggacgtgacgacccgttatacgaggcggagtgatgagatgtaccggaaatacgccgggtatttgctggagacggtacgggaaaagccggggaattatctggcgttttttccatcctatcgtttcttaaacgacgtctacgatgcatttcaggaaatgagaaagccggaagaggatctcttctgtctcgtccaggatccggggatgacagaagaagagcgggaagagtttctcaactatttcgaggaagagcgggaggggaccctgctcggattttgtgtgatgggagggattttctcggaagggattgatttgactgacgaaaaactgatcggtgcatgggttataggaacgggacttccacaggtttgtctggaacgggagctgttaaagcagtatttcgatgaaaagggaatgagcgggttcgattatgcctatctgtatccggggatgaataaggtgctccaggcagccggccgggtgatcaggaccgatacggatcaggggatgatctttttgctggacgaccgttttcagatgagccagtaccgggcagtgttcccaagggagtggagccaggtgaggaggattcggctttctcagacagcgaaagaagtggctgcattctgggagggaaccagaacgcagccacccgtatcagactaatatccaggtgtgttttcatcagtgagaatggcatccggagaggatcaaaagtagtccagaaatgcctgaacggaacgggacatggggatccggtcattataggcgatcaggagctgtcgctttggcagctcttcttttgtctccacaatgaaaaggccttcggaatctctgcttaggcagtaatccgggatgaacgcgatgccaaggccgatttttgccaggtcaatcagaaggtcattgctgctcagctcaatttccggcaccagatcgagttggtgctgctgaaagagagtatggaggaattcactcgttgtgcttttacggtccagcataagaatcggttgtttcaaaagctcttggtaagagagcttttgtcctttcagatgagagaaagaatcgttggccacaaagacatcctggaacgtcttgatcttcttcacagtagaaagctggttgatgtagttgtttggataattgatgaagatcaaatccacctgaccgttttccaggagatccacgcacttgatggatgtctggttcgtgaccttaatgtgagaggccggaaaactcctgtgaaagcgttccagataaggcacaaggaagtaacggcagatggtatcactggctccgatccgtatttgaccgccgatggagttggactctaagagctgattctccccacgtttaatcagattcatggcaggttccacatggcgcagtaaaatctcgccctcaggagtgagttggactttcttcgtgctgcggataaaaagaacctgatccagttttttctccagtgccttgatggactggctgacggcagactgggaaatataaagctgtttggaggcctcggagaaacttaagctcgaagccacatagtaaaagactttatataattcatagttaatatccatcataagtcctccttataaattctatctttattataaggaaagaaagagaaaaaaacaaggtgaaaaagttttactggaacgaggagccaggagaacgtataatagaaaaggaagacagacggaaaggacaggcggtaatgatgaaaaaaacgagaatattccacggtttcctggcagcggcagcagcagtgtcattgatcttgattctgcttttgagtgcatttgagatggcagcatatggggactttggcttttatgagaaagagtatgaaaagtatgagattcagaatactcttcccatggagatggatgatattatggatgtcacaaagaagatgatggcgtacttaaagggagaccgggaggagctttctgtgatgaccatcattggtggagagcgtcaggacttctttaatgaacaggaccgctttcatatgggagaggttcgggatctgttcctggcaggatttgcccttaggaaaattgccgttgttgttctggtcatatcggtggcgattttattttttttgaaagcggattggaagcggattctgccgaaagcgtatgagattacagtctgcgtttttctcgggctggtggcggtgcttgggattgccattgcggtgaattttgacaggtgtttcgtgatctttcacgagctcttttttgacaatgatttatggatgtttgacccggcttcagactatatgatccgaatgttgacagaaggattctttttcgacatcacactgcggatcggaggattcttcgtggcgtttcttcttttcttcgagagcctttgtctgggaataaggatttggagaaaaagaaagggaattagaacagcttataaataaatttaactatattaattatacttatcaagaaaagtatggtacactagatacagaatcgaataatcttttttgaaagaagaatggaggaactacatgagtggtgtaaaacgtgtatacgcggaaaaaaaacaggcgtttgccgtacaggcaaaagcattacagcacgagatcaagagctacctgggaattcgcggggtaacgaatgtccgtgtgctggtccgctatgatattgaaaatctgtcagacgagacgtttgaacgggcgtgtaatggtgtgtttgcggagcctccggtagacaccttatataaagagatgtttccgatgaaggagaatgagcgggcgttctcggtagagtatttgccagggcagttcgaccagagagcagactccgctgtacagtgtgtgcagttcatccgggaggacgaagagccggttattcggacagcaaccacatatgtgattgagggagagatgaccgatgaggaatttgaggcggtgaaagcccactgtatcaatccggtagattcaagagaaacaggcatggacaagccggagacactggtgacacagtttgatgagccaaaggacgttcggatttttgacggtttccagtatatggaagagggacgcttaaaagagctctacaattcgctgggacttgccatgacattcaaggatttccttcatattcagaagtactttcaaggggaggagaaacgggatccgtctatgacagagatccgagtgctggatacttactggtctgaccactgccgtcatacgacattctccaccgagcttacgaagattacgtttagcgagggtatgtacagagaacctatcgaaaagacgtaccgggaatatttacagacacacagcgagattttcaaagggcgtgaggataagtttgtctgcctgatggatctggcgctgatggcgatgcggaaactgaaaaaggaaggaaagcttgcggatcaggaagagtctgacgagatcaacgcatgtagtatcgttgttccgatcgaggtagacggaaaagaagaggagtggcttgtaaactttaagaatgagacacacaaccatccgacggaaatagagccgttcggtggtgcggcaacctgccttggcggggccatccgtgatccactctcaggacgtacttatgtataccaggcgatgcgtgtgacaggtgccgcggatccgaccgtgtccgtgaaagatacactgaaaggaaagcttcctcagaagaagcttgttagagaggccgcacacggatacagttcctatggcaaccagatcggacttgctacgggaatggtaaaggaaatctatcatcccgactatgtggcaaagcgtatggagatcggggctgtcttaggcgccgctccgagacgtgcagtcatccgtgagacgtccgatccgggtgatatcattatcttgcttggcggacggaccggaagggacggatgcggcggagcgaccggttcctctaaggtacacaccgaagagtccatcgagacgtgcggcgcagaggtgcagaaaggaaatgctccgactgagcgtaagatccagagaatgttccgcagagaagaagtcagccggctcattaagaaatgtaatgacttcggagcgggcggtgtttccgtagcgatcggagagcttgcggatggtctgagagtggatcttgacaaagtaccgaagaaatatgccggacttgacggaacagaaatcgctatctccgagtctcaggagcgtatggcagttgtcgtagatccgaaggacgtaaaacagtttttggattatgcaaaagaggaaaacctggaggcagtagaagtagctgttgtaaccgaggagccgcgtctggtgctttcctggagaggaaaagagattgtcaatatttcccgtgcgttcctggacacgaatggagcccatcaggaaacagaagttttcgtagagattccgtctgaagagggcaatatcctcacagagagaaaggatgtgccggacgtcagggcggcatggcttgcaactttaaaagatctgaatgtatgttcccagaaaggtctggtggaaatgttcgacggctctattggagcgggatctgtatttatgccgcacggtggaaaatatcagcttaccgagacgcaggccatggtggcgaaacttccggtactgacaggcaaatgcgatacggtttccatgatgagctttgggtttgatccttatctttccagttggagtccgtaccacggggcaatctatgctgtgacagagtccatcgcaaagatcgtggcggccggcggagactatcagaagattcgcttcacattccaggaatacttccgcagaatgacggaagatccgaagagatggagtcagccgtttgcggctctgcttggcgcttacagcgcgcagatcggatatggcttaccatctatcggaggaaaggacagtatgtccggtacgttccaggatatcgatgtaccgccgacccttgtttcttttgcagttgatattgcgaaaaccggggatatgattacaccggaactgaaaacagcgggtaataagcttgtatggcttcggattgagaaggactcctacagtctgccggtatatgctcaggtgatggatcagtatggaaagttccacgaggacattcagaatggcaatattgtttccgcctacgctttggatcgccatggaatggcggcggcagtcagcaagatggcttttgggaatggcatgggtgtgaagatcgagcacaatctcgatccaagagagttttttgcgcctggattcggagatctgattgcggaagtaccggcggacaaagtaggaaaacttgccgttacgtataccgtgattggcgaagtaacagacgatggtatcttctcttatggaaatacaaaggtgacactcaaagaagccgagtcagtatggaaagcgccgctggaaaatgtatttgcgaccatatcaggtgaggagacggctccggttcttaccggaattgcaccggaagatgaagatgcggtcattacagaagacggatgctataacacgaagaatgtgtatatttgcgggcacaagattgcccagccgactgtattcattccggtatttccgggtacgaactgtgagtacgacagcgccagagcatttgagcgtgcgggggcaaaggtcatcacaaaagtatttcgtaatctggatgcagcggatattcgcgactcggttgcagagtttgaaaaggccatcgggcagtcgcagattattatgttcccgggcggattttccgcaggggatgagccggacggctccgcgaaattctttgcgacagcgttccagaatgaaaagatgaaagaggcggtagaaaagcttctggaagagagggatggactggcgctcggtatctgtaacggattccagacactgatcaagcttggattggttccgcacggaaatatcgtgggacagacaaaggatgccccgacattgacgtataatacgatcggacgtcatatttccaagatggtctacacaaaagtagtgtcgaacaagtccccatggcttcaactggcagagcttggcggtgtttacacgaacccggcttctcacggagaaggacgctttgtggcaaatgaagagtggcttacaaaacttttcgcaaacggacaggtggcgacacagtactgtgacctgaacggcaacgtgacaatggaagaagagtggaacgtcaacggctcctactgtgcaatcgagggtatcacaagcccggacgggcgagtactcggaaagatggcgcactccgagcgtagaagcgacggcgtagcgatcaatatttacggagaacaggatctgaaaatttttgaatccggcgttgcttacttcgaataaataagtgattgaataaaaaggagacagattctaaaaacaggatctgtctcctttatttagagaagagagcgtatcatcggttctttcatttgctttttcctaaacaggaatgatcgaaattcggctgggctttggattggtggattttttctgttccggcggcgattgccgtttcgtaataccagcatttatagttgacagtatctaaaattttctgtaattctgccatctgttgttttacaactcgtctgcgttccaaaaacatgtcatatctctgctgtaaggaggagtctccttgttccagccaactgctgaactgacgtatctctttgatagacataccggtttttttcagacaatctatgatacgaagcgtagcaatatctttttcggtaaaaatccgatatcctgatgccagtcgttctacaaatggcagtaaaccctctttgtcgtaatagcggatagtacttgtcgggacacccatgatccgggctgcgtcctttatggtgtatttttttcccatatgatcttgctccttaaattttgaaaaatttctcaaaaaacattgactttaaactcaagtttaatgttatgctgaaatcaatcaaaagtcaaggaggatatttatgttaggaaatttttcgtactgtaaccctacaaaactatattttggcgaggacgctcttgagaatttaattgttgaactggccaaatacggaaataatgtcgctcttgtttacggaagcggctcaattaaaaaaaacggaatttatgatgaaatcatggatattctaaaatctgcgggtaaaacggtgtcagagatagcaggtgttatgccgaatccaactgttcacaagctttacgaaggagttgaaattgcaagaacacataaggtcgactttatccttgccgtgggtgggggctccgtagtggactatgcaaaagccctgtctgtctccattcactgtgaagaagatccgtgggagaaatattatgcccgatttgaagagccggtctgtgaaatagttcctgtgggcgttgtgcttactatggttggcacgggatcggaaatgaatacaggcgcagtgatcacatatcccgaaaagaaactgaaaataggtcatgtgtttacggatgaaaggattatgccgaaattttccattttaaatcccagatacactatgagtcttccgaaaaatcagatgattgcaggcatttatgatatatttaatcatatttgcgagcagtatttttccggtgaggacgacaatacgagcgattatatcagtgaaggcttaatcaaaagcgtgattcattccagccgtattgcaatcaaagacaagaatgattatgaagcgagaagtaatcttatgtggtcggctacctgggcgttgaacacgttggtgtcaagagggaaaagcaccgattggatggtgcatatgattggacagtcggtgggggcgtgcagtaacgctacacacggtatgacattatcagcggtttctttgccatattataaaatgattatgccatacggcgtacggaaatttgcccgttttgccgtgaatgtctgggatatttctcctgacgggaaaaatgaggaagaacttgccaaggaaggtttgtccgctatggaagcgtggatgaaagagcttggtcttgctatgaaactttctgaaataggagtgacaatggaaatgatcgatgatattgtcaatggtacactgattatggagggcggctataaagtactttccaaagaggatgtcaggaaagtgctgatgcagtctatgtaagggaggagatgcggacattgcaatttcatattcacagtttaaacggttggtcttcagagacgaaccgtttttcttatttcataggaaactgtgttcctatgaaataagaaatgctccgcgtggatcgcactgcggtggagtggggagctgccgctgaagcggccgccgcaggcgtagaatcctgtcaaacaggattcttttttatgtgagaagtcttaatatttggaagggcacttgacattctgctgtttatcatataacatgaaataaacttcatgtgaagtttgcttcatgtaagaagggatgtgggatatgaaaacacggataagagaattacgaaatgcaatgggaattacgcaacagcagttagcggatttcgttcatgtttcaagccggacaattatatcaatcgaaaaaggacagtacagcccatcgctaatgcttgcttaccgtatggcacaggtatttcatacaactgttgaagatttatgctgcttaaaagaaaataaggagatagaggataagaattatgagaatctataataaaaggaaattttttattggaattggagaattcatattatctattgttgcatttgtaaccatgtttataacccgaacaatagatataaaatttattgtagtcaatgtgattgtttttactcttggtattgtgaatatttcgagaagtctttcaaaatcagatacggcagaagatattatagaagaaaatgacgagagaaatagacttatcagcctgcgcattaacaatatgcgttataaaatattgattgtggtaatctacatatctgttgtcgcaggtatgctagcgtatggagtaacaagaaatataaacatagttatcgcgttactgccattgcttcttctattgtgtatctggtttctttcttcttttatcttagctttttattacgagaagaagtgttaaagcaagaagcccattctgtggggcaccgatttgacaggagttaaggcggtgagtataataaaaacgtaaatttgcctgttgatgcaatgaagggggaagcaatatgccgtccagcagaatcggaaaatatatttcaattttaaaccgccagtctcagaagtatcttcatcatctagtggagcagtatggaatcggatattccagttactattttgtgatgtacattgggtccaatccgaaatgcagccaaagagagatgtgcgattctatggcgatggatcaggccatggccacaagggagatgagaaggctggagcagtgcggatatattatccgggaaaaacgtccgggcaatgcgaagacctatgagatttctctttctgatagcgggcagaggctgtaccgggagttaaagaataagctgatggagtggtggggagagctgcttgaggagtgtgcaatcgatccggagccattttcagaacagcttcggatcatggcaaaggccgcctatcaaaaagccggaggaacggaaagcgagggaaaacgcaccgaaaagatgcgataaaaaattcttgacaatacgaaaaaaatgctttaaagtgttaaagaagaaaagcggagcacgaaaatgcaggcttttttaggagagaataggaggacgatattatgtcatatgtagatgaagtgattgaccttgtagtgaagaagaatccgcatgagcctgagtttcaccaggctgtaaaagaagttctggaatcacttagggttgtgattgaggcaaacgaagaaaaatacagaaaagaagcattgcttgaaagactgacggagccggaacgacagattctcttccgtgtaccgtgggtggacgacaatgggcaggtacacgtcaacaaggcataccgcgtacagttcaacagtgcgattggaccatacaagggaggtctcagacttcatccatccgtcaacttgagtattattaagttcctcggatttgagcagattttcaaaaactccctgaccggacttccgatcggaggcggcaaaggcggatctgactttgacccgaaaggaaaatccgacagagagatcatggcattctgccagagctttatgacagaactttgtaaatatatcggagcggacacagacgtgccggcgggagatatcggaacaggagcaagagagatcggttacatgttcggacagtacaagagaatccgcggcgtgtttgaaggcgttctcacgggaaagggactgactttcggaggatccctcgtccggacagaggcgaccggatacggattattatatttcacagaagagatgttgaaacttgccggcaaggatatgaagggtaaggtggtcgctatctcgggagcgggaaatgttgctatctacgctgcagaaaaggcaatgcagatgggagcaaaggttgtgacaatgagtgattctaccgggtggatctatgatccggaaggcattgatctggacgctgtcaaagagatcaaagaggtcaaacgtgcaagacttaccgagtacaaggaataccgtccgaactccgagtaccacgacggcgtcggcgtttggtctgtcaaatgtgacgtggcgcttccttgtgcaactcagaacgagcttcatcttgaggacgcgaagcagcttgtggcaaacggatgtatcgcggtagctgagggagccaatatgccgacaacgatggaggcgacagaatatttacaggcaaacgacgttctcttcgctcctggaaaagcatccaacgctggcggtgttgcgacatctgctttggagatgtcacagaacagcgagcgtctgagctggtcctttgaagaagtagatgagaagctgaagacgatcatggtaaacatctgccacaatgcggcggatgcggcaaaaagatatggatgtgagggaaactacgtagccggagcaaacatcgcaggctttgaaaaagtagcgacggctatggaagcacagggaatcgtctaagatagtaactatgcagccataccgctcagattcgccagttgcgctgctttttcgcaagatagaaaaaagataaaaaaagtgttgacatttcctggatgataatagtataataatcaagcgggttgcgaaagcgacccgcaggatatgggatcttagctcagctgggagagcatctgccttacaagcagagggtcataggttcgagccctataggtcccatttcgtaagaaattacgaaacatacggcgggatagctcagttggctagagcatacggttcatacccgtagtgtcgctggttcgaatccagttcccgctattcatatgggatcttagctcagctgggagagcatctgccttacaagcagagggtcataggttcgagccctataggtcccatttcttatgaaaacaaaacatatggcgggatagctcagttggctagagcatacggttcatacccgtagtgtcgctggttcgaatccagttcccgctactataccatgggaagagatagaggcgtcgcaaatgtgcgacgtctctttttggtatgagcggtttccaaaaacgattgtaattaccggagctttcagatataatattggaaaatcgtaagaaaaggggaaagatatggaattacgactgaatcatgtgaaaaaatcgtttggggataaaacggttttagatgactgctcatttgtgtttcagcaggggaaaatctatgggcttcttgggcggaacggcgcgggaaagacgacgttatttaattgtctgagtgatgagatccagccagacatgggaaatgctctgatctgtgatgatgagggggagcatgtgctgctgccggatgagatcggatatgtgttttcggttccggtacttccggattttctgaccggagaagagttcgtccggtttttcatggatattaaccgggatcggatcgagacgggagcgagtgcggagacatatttcgacctcgtacagattgacccggaggaccggagaaagttgatcaaggggtattctcatggaatgaaaaataagttacagatgatctgttttatgatctcgcggcctccggtcattttgctggatgagccgctgacttcgctcgatgtggttgtggcgctggagatgaagcagcttctccgcaggatgcagaagaatcatgtgattattttctccacccacattttacagcttgcgacagatctgtgtgacgagattgtcgtattaagtgagggcaggcttcgccagatcgaccatgagatgttaaagagcaaggattttgaggaacagatcattgaattgttgaaagatgaggagaagcatgagtagagcgttacgtcagattgttatgatgcgggccaccattatgacaaatacctttttgtattatctgaaaagactgtggctcattggaaagctggttcctgaccgtgtgtacggtaatccggatttcaagattgtgcttgcggtgctgtttaccattgtaggacaggtagtcagtctgaccggcaaagtactttatgtactggttatggtggtactgccgacgtggatgatgaaaagagtacatgtggacgcgtttgactacatggttcagattttatttttcctgtcgtgtttgatgggaccgctccaggacagtgtcgtgttccaggtgacaaaagagaagtttacttgtatccgctacatgaagatggacgctcagaaagcagtcaaagcggttttatgttaccggtacataccgtttgcgctttattttctcattgcggtagtgggaggcgcctggttcctgggcgggagtgtgtggaacggcatttgtctgtggcttgtgattgtgatgttccgggcagcgggcgaggcgttccaggtatggtattttgacagaacgggtattatattttccagaagatatggatgggtctggatcgtcatcggtctttcccttgtgtgtgcctatagttgctgggcagtagatccgtttgtgagggcagcatggctgttccatccgatttgtctggttctgatatgtggtatggggattgtttccatctggtacttggtggcagggtatcagggataccggcagaagcttcaccggactatggaagagaagtggatgctgtcttcgattatgaagcagtccgggcaggaatcaatagaaaaagaagtcggggtgcgggagcgggatcttaaggtgaatacctcccggatggccgggattaagaaacttcatggatatgcctattttaacgccttatttttcctgagacatgagcggcagatcaagagaccaatgtattaccggctggcagtggtggggatctgctttttgggcggtgtgacgcttcggatcttttcaccggaggcggcgtacctcgcgggtatcaatcttccggaatttttgccgcttcttgtgtttatcatgtacatgatgaccgttgcggacaaggcgtgtaaagtcatgttttataactgtgataagagtatgctgaggtttggattctaccgcaatcccaagacgctgctatccatgtttcggatccggctgatccaggtggcaaagtacaatgtgatgatcggcgcggccatctgtgcggcagtcgtcgcattccggatggtgtgcggtatctgggaatttgatggaaacatggcgttattctgtttagcagttttggtgctttccgtatttttcactgttcaccatctctttttgtattatgtcttccagccatactcggaggaaatgaatgtgaagaatccgtttttctgggcatttaacatggtaatttatgctgtctgctttttttgctatgagatccagacaggaggtgtcttctttacgatgggtgtgctggctgtgacgactgcttatattatcgttgcgctgatgctggtatatcggtttgctccgaaaatgtttcgtgtaaaataactgcccttttgcgggaaatgtgataaaatagggtcagcagagacaaggaggaggaaaaggatgaagaacaaccgtataaggcggattttgatggtggccgccggtatttacctggcttacacaggctttgatcttacgagagcggtcatcggaagttccgaaaagaataaatgggtctttctggcgtttgccgtgctctttcttgtgtttggagcgacggttattgttatgaatgtcagaggcatgatacaggattacaaagatggcaggagagagaaaaaatcagaagacagagaggaggattcttattgcgaatagggatgggatatgatgtccataaactgacagaaggaagagagttgattttgggaggggtaaagattccttatgagaaaggattgcttggtcattcggatgcggatgtgctgctccatgcggtgatggacgccctgcttggtgctgcgtccctcggtgatatcgggctgcactttccggataccgatgaagcctaccggggagtttccagcttaaagcttcttaagcgggttggggagcttttggacgagcatctttatgtgattgaaaatattgacgccacgatcattgcagagcggccgaagatgcgtccgtatattgatgagatgagggaaaatattgccagagcactgacgctcgatgtggatcaggtgaatatcaaggcgacgacggaagaagggcttggatttaccggaaaaggggaaggcgtttcctcccaggcaatttgctgtattgagaaaatgacgaatttcagctatgatgtgacggagcagggtacaggatgccggaactgccagggatgcggcatatccaaaggacaggtgatatgatgcggatccgaaagcttacgaaggcggaacatggagtcacccgtattctctgggaggaagtctttaccgaagatgaagatgcgtttttagactactattatgaagtgaaagcaactgagaatacgatctacgtcatcgaggacgatgcgggcgatccgctctccatgctacagctcaatccgtattcagtccgtttcggaaagaaagaccggacgctgcattatatcgttgcggtagctacaagagagaagtaccgggggcggggatatatgagagagcttctggaaacatcggccagcgaaatgtaccgtgacggggagccgtttacttttcttatgccggcggcggaggcgatttactatccgcatggattccgtttcgtttatcgtcaacgacagatagatggcaaggtgaaagacggtctggctggagagggaacggtgcgtccggccaccttgtcagactgccctgcccttgcccggtttgcggaggaggtcttaagtgagacagaatgggtccgggcggtccgaacggaggagtattaccggacgcttgtaaaagagcagcaaagtgaagggggcaggattcttgtcactgagtgtaaaggacagatccggggatttgtcctttatggatactgggaaggaaaagcagagcttcgggagccgctcgtttatcaggagaaggactggcaaagtctggctgcctttctggaaaaggagccggtggacaggctccatatcacaggtattctcccacggctggagccgtggatcgaaaggagtctcgccgaaccggtcaaaaaagatgtgccgatgattatggcgcggattgtgcatttgggacagtttctcgaaagttttcgggcgaaggcggattttactgtcaaaattcaggtggaggatgaacggatcccggaaaatacagggtgctgggaggtttacggagaaaacggagcgtttctgagagccgaaaagcaggaagagactacttccggtgatacagacgaaaaagtcactccgggagaccttgtgaccgcgctgtttgggtatgacgacaagaagggcaggaataagaacgaggagaaggacactgaaaaggacggaaggagtgtagggacgaatcttcggatcctggcagatggtgtagttgcagctccaccagtcttcctgaacgagatagtctgatggaagttcaagctgcggatccaaaccgcatgacggaatcgttgtcatgtttgacagaaatgtgtggaataggagttgacaaagaggctgttatcccatacactataaaaacagaaggataggaaaaggtgaagaacgggaagagtagcatatgcatgctttacagagaaggaaggtcatcggctgagagccctccgaaagaacggatatgtgaagtgcgcccgggagccggatctgtgaaaagagagtagcagaccacgtaagcagtcgttacctgcatacatgagtgaaaagggcggacgccctttttaatagagtggaaccgcggatcaacttcgtctctaagccagggacgaagttttttatatcattggaaagtccttcggactgacggatctatcaataaaaaaaggaggagaaagaaaatgaaactgtacaacacaatgacacgaaaaaaagaagagttcgtgcctctggaagagggaaaggtaaagatgtatgtgtgtggtccgaccgtttacaatttcattcacatcggaaacgcaagaccgatgattgttttcgatacggtacgccgctattttgaatacaaaggatatgaggtgaaatttgtctctaactttacagacgtggacgataagatcatcaagaaagcactggaagaaggtgtgacggcagatgagattgcgggacgctatattgaggagtgcaaaaaggatatggaatcccttaatgtaaaaccggcgactgccaatccgatggcgacgcaggagataggcggcatgatccagatgattggggagctgatcgaaaagggtcatgcgtatgagaaaaacggaaccgtgtatttccgaacaaggagttttaaggactatggaaagctctcccacaaaaatctggacgacctgaagtccggtggaagggagcttctcgtatcaggccaggatgaaaaggaagatccgctggatttcgtactctggaaaccgaaaaaggacggagagccgtactgggacgcaccatggagcaagggccgcccgggctggcacattgagtgttctgagatgtccagaaaatatctgggcgagcagatcgatatccatgccggcggggaagatctgattttcccgcatcacgaaaatgagattgctcagtctgaagcatgcaatggtaaagaatttgcacattactggatgcacaatggatttttaaatattgacaataagaagatgtccaaatcccttggtaatttccgtactgtccgggaaatcggtgaacagtatgatctgcaggtattccgctttttcatgttgagcgcccattacagaagcccgctgaatttcagcgccgagctgatggaggcggcaaagaacagcttcgagcggatcaccaatgcggtagaccatctgaaacatttgatagacacaacaaagacagaaacaatgacggaagcggaaatagagcaggaaaagaaaagcgaagagtttgtggcggattttgaaaaagccatggaggatgattttaacacggcggacgccatcacagccatctttgagcttgtgaaatttgccaatacaacggcagatggagagagctccaaagtatacacaaaggcacttcttgaccggattgtgagtctgtgcgatattctgggactgatcgtagaaaaaaaggaagagatgctggatgcggatatcgaagcgctcattgaggaacggacccaggcaagaaaggaaaagaacttcaagcgtgctgatgagatccgggatgagcttctggaaaagggaattgtcttaaaggacacgagagaaggagtacaatggaaacgagtataacgatggaactggacgcctatttgtgtgaagtatttcaaagtgaagaccatgacatcagaagttattcgtcgctgtctctggcgtttatcggagactgtgtgtatgatctgatgatcaagtcactgattatccggaaggggaaccgtccggtcaacgccatgcaaaaagagacgagccgacttgtgcaggcgtccgcccagtcttctatgatgcgtgttatgcaagagcatctcacggaggaggaacacgctgtctaccgaagaggccgtaatacaaagtccgtctccccggcaaaaaaccagtccatcacggattaccgcagggcaacaggatttgaggcgctgatcgggtatctctatctgcaaaaggaatatagacggattgtagatctgataaaaatcggcctgaagggcctggaggaaaacgatgaaagagcagaataataggaacgaatcgatgattgaagggagaaacgctgtattggaagcgttccgctccggaaagacggtagataaactttacattctggacggatgtcaggacgggcctgtgcgtacgatcgtccgggaggcaaaaaagcgtgataccattttgaactttgtgacgaaagagcgcctggatcagctttccgagacaaaaaaacaccagggcgtcattgcaatgacggcggcttacgaatattcggatattgaggaaatgtttgctctggccgagaagaaaggggaagatccgtttttgatcctcctggataatattgaggacccgcacaatttaggcgccattatcagaacagcaaatctggcaggagcccacggagttatcattccaaagcgccgcgcggcgggattgacagcgacggtttccaagacgtccgccggagctcttaattatacaccggtagctaaggtcaccaatctggcaaagacgatggaagagctgaaagggagaggactctggtttgtctgtgccgatatggacggtgatgccatgtacgatgtgaacctaaaagggccgatcgggcttgtgatcggaaacgagggagaaggtgtttccagactggtcagggagacttgtgattttaccgcttcaatcccgatgagaggggagatcgattctctcaacgcatcggtggcagcgggtgtgctggcatacgagattgtccgtcagaggaccagataaaggagatttaaggtgatgacggattatgagaaaaaaacagatgaagaacttatcatggactttcgaggcggggatacggcgatcatggattatcttctggagaaatataagcctatggtaaagaaaaaggcaaaagccatgtatttgctcggaggagacagcgatgatctgatccaggaagggatgatcggtttgtttaaagcggtgcgggattatgattcggcccaggaggcttcttttggtacgttcgcccagatctgcgtgacgaggcagctctattcggctatccgggcttccaggagaaaaaaacaccttcctttgaattcttacatttccctctatgataatgaggagatttccgaggagaaagagtctgagctgattcagatacagaatatagcctccaccaataatccggaggatctggtgattcacaaggagtccgaagactcttttatgaatgagctggaagggaatttaagtgaactggagcgaaaggttttgtatcttcaccttcttggaacggattaccggacgatcgcaaaacttttaggaaagagcccgaaggctgtggacaatgcgctgcaacggatcaaaacaaaagcggaagagctgctgacttctatttaaaaatagtacaaactgccaaaaaccattctgtcagtaagaacaggtttttggcagtttttttgtaaatatcagtgaaaaaaacattgacagctcaagaaaaaacgcttataatcctactgttaggaaacgaacaaaataacaggggtggaaatcatggacaaagaattcaaagaggagcgtgagaaccatgtcggccggatgatccatatgctgtctcaccagctcaagaggcgaggggcggtgccggagatggagaccgggctgacgccgatgcagaagcacatcctgacttttattctgtttgagacgatggaacgcgatctttatcagcgggatatcgaggaggagttccggatccgcagatccaccgcaagcgggatcctgaagctgatggagaagaatggtttcatctaccgcaaaagcgttgcaagagacgccagactcaaacagattgtcccgactgagaaggccgagaagttccggatggatattctgatgaatatcaaagagacggaacggagactgacggaggggattccgaagccggatctggaagtgtgtctcaaggttcttcgtcacatgctccttaatctgtcaggagaaggacagatcaaatgaaaaattatgggaggtagagatgaacagaaaactttttaaatcaatccgggaatacaaaaaagaatccgttcttgcaccattatttgtcattctggaagtcttcatggaagtgctgattccgcttcagatggcaaagattatcgatattgggatccaggacgggaatcttccttacattatcaagatgggggtcattctggtcatcatggcaatgctggcgctctggttcggcgtaaaagccggaacctatgcggccagagctggcgcaggatacgcaaagaacctgcggcatgacatattttacaaggttcaggagttttcctttaaaaacatcgaccatttttccacatccagccttgtaacccgtatgacgacagatgtgaccaacgtacagatggcatacatgatgagtatccgtctccttgcgagagcgccgattatgattgtgctctcctggattatgactttgacgatcaatgtcaagatcgctttattgttcctcgttgtcattccgcttctcggcggcacgctgatctttatcgcaaagaaagcgcacccgcattttatcgctgtgtttgatgagtacgacgttctgaacaatgtcgtgcaggaaaatgtcaatgcggcgcgtgtcgtaaaagcatacgtaagagaagactatgagatcaaaaaattccataagatttccaaaaaggtatttgatctctttacaacagcggagaagatcgttgcgtggaactcccctacgatgcagttctttgtatacaccgtcgtactttgcatggtactgatcggtggacgggatatcgtattccaaacgatggagaccggagagctgaccagcgtgatcgtgtatgcgcttcagattctgtcttcattgatgatggtatcctttgtcttcgttatgattatgattgccgaggcgtccagcgaccgtattgcggaagtattggatgaagtgccggagatgagcgacaagccggacgcggtgaaggtcgtgccaaacggagctattgattttgaaggtgtggacttcagctatgcaggagaaggtggtaatctttccctgaaaaatgtcaatattcatattaaatccggtcagaccatcggtattatcggtggaaccggaagttccaagtctacatttgtgcagttgattccgagactttacgacgtgacgaaaggatctgtcaaagtcggcggtatcgatgtgcgtgactacaatctggaagcactcagagatcaggtatctatggtgctccagaaaaatgtcctctttactggaacgatctatgacaacatccggtggggagatgaaaatgcgtccgacgaggaagtgcagagagtatgtaagctcgcccaggcggatggcttcgtacaggaattcccggcgggctataatacgatgattgttcagggaggaaacaatgtttccggtggacagaagcagaggctttgtattgccagagcacttttgaagaagccgaagatcctgatccttgacgactctaccagtgcggttgacacgaagacggacgccatgatcaggaaagcattccgggaggagattccggataccaccaagatcatcattgcccagagagtttcttccgtggaagatgcggatttgattattgtcatggatgatggaaagattaatggaatcggtacatcagaagagcttttaaggaccaacgcaatttacagagaagtatatgagtcacaggtcaagggaggtgaggaggatgaataaaaacgatgaaaaggtacgtgtatccaaaggcacgttaaagacagcaaagcgattactccgttatgtgaccagccgttataaagtccagttttttgccgtatttatctgtatcattatcagttccgtggcttcgatctctgtatctttgtctctgaaatttttactggatgattttattatcccgctgatcggacagaaatctccgaattttacagagctttatcaggcacttggagtattggggtgtatttttctctccggtgtgatttcatccttcatctatacaagactgatggtaacgatcggtcagggtgtcttaaaacaggttcgggatgatatgtttgagcatatgcaaaaactcccgatccgctattttgaccagaatacaaacggctctattatgagtctttacacgaatgatacggatacccttcgccagatgattaaccagtctatcccgcaggtactgatgtcctcgattaccattgtggtaacctttatctcaatgcttgcgcttagtccgctgcttacgattctggctgtggtgatgattgttgttctcatcacagtggcaaagaagattggaggtaacagcggaaaatacttcctcaaacagcagatagccattgcgaatatcacgggatttgtggaggagcggatgaacggtcagcgtgttatcaagattttcaatcacgagcgtgtgtctgaagaagagttcgatgaactcaacgaaaaactgtacgacagtgcggcaaacgccaatacgtttgccaatatgatggggccgattatcggtaacatcggaaacctgcaatttgtactgactgcggttctgggcggatttttatccgtcatcggagtaggcggtatcacccttggcgttatggcttcttacttacagtttacgaagagcttcacccagccgttcatgcaggtagcgcagcagtttaactctatcgtcatggcgcttgcaggtgcggagagaatctttgccatgatggatgaagagccggaagtagatgagggatatgttacccttgtcaacgtccgtaaagatcagaatggcaattttattgagtgcaaggaaagaaccggtatgtgggcatggaaacatccgcaccaggcggacggtactgtaacctatacggagttaaaaggagatgtgcgcttctttgacatgacttttggttatacagatgaaaaaatggtacttcacgatctcacactttacgcaaagccgggtcagaagattgccttcgtaggctctaccggagccggaaagacgacgatcaccaacctgatcaatcgtttctacgatgtacaggatggaaagatccgttacgatggaatcaacatcaacaagattaaaaagtatgatctgagacggtcccttggaattgtgcttcaagatacacatttgtttaccggaacgattatggagaatatccgttacggaagactggatgcaaccgatgaagatgtctatgaggcagcaaagcttgcccatgcggatcagttcatcaatatgcttccaaacggctaccagacgatgttaagcggagacggagaggagctttcccagggacagagacagcttcttgccattgcaagagccgctgtgtccaatccgccggtactgattctggatgaggcgacgtccagtattgatactcgtacagaaagtatcgtgcagaaaggtatggataacctgatgaaaggacgtaccgtttttgtcatcgcccaccgtctgtctacaatacgtaacagtgacgcgatcatggttctggagcacggacgcatcatcgagcgtggagatcacgaagacctgatcaagcagaaaggcacctactatcagctctatacagggaagttggagctctcctaaaataagaacaggggaaaacggctgcttggaagaaaagaatgtaagaccgcctccctggccggacaatgtatctggtcctggaggcggaattgcagtcagggaagagaagggtgaagacgagggaaggctcatgttgcaatccacagaaatttttgattttcacttgacaattctgaatatttacgatatagtaaataggcgttaaagatgtgctgccttggctcagtcggtagagcgtcgccttggtaaggcggaggtcggcggttcaagtccgctaggcagcttggaaaactcctgagaaatcaggagttttttgtatgcagttttcatgttttgtaccgttcaaaggaaaaaagtattcttttaaccgtaatcccctaatttatgcttcgtttgtgttatatagggaatgggcaaagcacctcaataagaaatgatgataataagatttgagaatttgattattggaaaatgaacacgggaactgttcgccatgtgacgaccgattcccgtgttcatatataggatgaaaaatctatggaggtttgaaatctttgttgaaacaggttttcttctagttctgagccgccgccagtttcttctttgacatgctcatgcataagagcagcaggaagaaagtcagtgccatacagatcaaacaggccggccagatgatggagtagtccccagtcaggtcaaagaggaaggaaaccagaagggttccgattccgccgccgaaccggttgacggatacgaccataccgtagatcggaccataatccttgttgccgaagatcgtacttgtcagcagagtcggcatcacgcttgtgataccggataccagaccgtaaaggacgatcatagctgccatcatcgccggatttttcgcaaagatgaagaagaggaacgccaggacgcctgcagagcagatgtagatggttgcgttcttcacacctttcttatcagaaaaccatccaaggaacagtcttcccaaaataccaatcgcactgtatgcggatactgctttggcagcgacagcaggagagtaaccaatgtcctgtaagtaggttggtatttgcagagctgctccagttgccagtgtcagactgaaaatagcaaggaggaagaagtaaaggatcggagagcgtctcgcttcccgagctgtcattccgactgcctccgcagcctgttttgctttctccttgacaatacctgcggcctgggatgtctctgcgccataagcctgaagtccgatatccttcgggcggctgcggacaacaaggaacagacaaggcactacgatgataaacatggcgatgccgacgatccggtcagagtttctccagccgaaatcagaaatcagatagctgactactgggcttaacaccacaccgcctgcgcttgtaccgatggaagcaaaactgattgcgaatcctcttctctccttaaaccacattgtaaggaggatggagatcggaagcagcgtacttccggtgaaaaacacacctttgataaaagcaagcggaagaatgaaccagatgcttggacagaacgatcttgctatcgtacagagtgcaacaacagagactgccatcggaagtagctttctggcgtcttttgtcttatagagcttaccccagtatggagctgttacgacagcacctacggtgatgcagatactttgtagggaaagcagagtcctcggcacctggaggtcgttgtacatcggtacgatgtagaggttgctgagctgcatgacgatggactgcacaataaaattgattaaaaaacagcaggccagaatgtaccacgcataatgaattttctttgtttgtttttccattcttttgttctcccttcctaatgaagtgttaaaaatgatattcctatcaatagcttattgatgatgttttagccattccatggcgatctgtgcatgagcggcggcaccgattggcagacagtcctcatggaagacaactttcgggtgatgctgaccgtatggggtgcccggaacgacattggcgccaagtacaataaagacagacggcaccttttctgagataaaagcaaaatcttcggagccagggaaggattttcttatgtccttgatctgatcctgcgggaacaaatcggcaagatacgatcttgcgtcagcggcgacctgagcgtcggagacgagcggaattgcgtagtttggatcgaaaatgacctctgcttccgcccggaacgccatggcagtggcatcgcagatttctttcattcgccggatcaacaattcctgtacttccgaagaataggtgcggatcgttcctttcattaccgcctcgctcggaatgacattgaacgtatcgccgccctggatagaaccgatggtcagcaccccggtctccccggctttcaactccctggcctgcaattcctggagggaaatcaggatgtgggcagccacattcagagggtctatggtcttgttcggtgtggaaccatgtccgccgcgtcctttgatcttaatcgtaaacagatcggaggatgcacaagccggaccagtgaaaacaagaagttttcctgtcggcacgacagaattcacatggatcgccatggcagcgtccacatgtggactttccagaataccctgtctgatcattgccttagcgcctttcatattttcttctcccggttggaagagaagcttgacggttccagttaattcactttctctttctttcagaagctttgccgcgccaagaagcatggccgtgtgaagatcgtgtccacagcagtgggcttttccatcggtggaagacgcaaatggaagtccgctttcttcctggatcgggagagcgtccatatcagcacgaagcagaaatgtcttgccggtggaaggccccagtgtgacgagaactccgtttggactcacaggtaccggattgcagcccatttcccgaagtttctctgttacaaaagcagtggtttcctttgtttccagatccagctccggatgctgatgaagccatctgcggttggctgtcaactcttcttttaactccatagcccgttctaaaaatgtgtttgtcatagctctgacctctctttctttgtatactatttattaaataattaatatactatttaataaataagataaataaatccataagatttgtcaataggaaaaagaaaaaatgtatgaaatggtgaaaaaaacactgacaaaaatatgcaaaatgaacaaaggaatgactatgaaaaaacaagagacagatttacaaaatgagaaaaatacattatactggttaacagtagaaagaagattttatgaaatgggagaagtgcatgaaaccaaaaatagctataatatcttcagctcatttttgtgattacattaaatggatgatcacatattatcatttgaatttagaggagcactgtactcttcattattatgagtatgaccagatcagcgggcttccggatgtatatgagcagatttttgacgagtacgacggattctgtgtgactggaaacacaagtaggcttgtgattcagatgcagtgtccggacaagaaaaagccgatccgcagtatttccgcaaagtcggcggagtattataaggaatttttcttcctcatcaacgagcaccgagatctaagtctcgaacgagtcgcgttggattcctattactggatgaaagaaaggggtccgtccaatattccagaatttatagacgaggacaggcgtcttgcggatatccaaaaagatgttgtggagaatattccactggaacggattcagcaggcggaacgagccatcgtgacgggagcaaagaaagcgtgggaagagggcagtatcgatctggtggtctgccgcttttcctcggcatttccagcattacagagggaggggattccagcggcatttgtctatccgaccagcgataccgtagttggcgctctggatgccttgttccgtgatattgaggaaaaacggcgcaaagaagaatacccggccgttttgtttctggcctcggagcagaatgaggatggggtcgagtctggaatcagcatggataacctgatcctccagaaatgcctcctggaatttgaccgggagcaaatggctggttttgttgttaatcaggcacggtcgggatacgagatctatacggcaggcaaggtagtcagaaagattacggacgaatacgaaaaggatggtcttggagaatacattttccagaaatccggcattcaggcgtggatcggttacggcatcggaaagactcttgtgatggcccgccaacatgcggcagaggcctttgaggcagcgcagaaggaaaagaaaagtttcctgatgaaagaggacgaagtgctgacaggtcctcttggtagcggcaagaagatgagatttgcggtagaggctcctgctttagtacaggaggcggctgtgcggaccgggctttctgtcagcaccattcagaggatctgtgcggtggcaggatggctggaaaaagacgagatgacagcacaggatctggcatctggtttacaggttacagttgccaatgccaaccgctttttaaacgcacttctgatagggggctatgcaacgattacccagaagaaaaaaagcggtcagagagggagaccaagcagaatttacaagattctgctggataagatcggtgcgtagacaatggagagcgctttttgcttgtggttacggtggttttatgataacataaaaattatgaatgaaatcctatgaggagggtgctatggagacaatatcaacggaatccaagaattttattgaacaggaaatagaaaaagacttaagagagggagtgtatgatcatgtgtgtacccggttcccgccagagccgaacggttatctgcacatcggtcatgctaaatccattcttctgaattacggtctggcaaaggagtataacggagagttccacatgcgttttgacgacacaaacccgaccaaggagcggatggagttcgtggattccatcaaagaggacattaagtggttgggagcggactgggaggatcatctgtattttgcgtcagattattttgatgtgatgtacgagtgcgcgctgaagctgatccgcaagggtaaagcctatgtctgtgatctgacgccggacgagatccgtgagtatcgtgggacgctgacagagcctggaaaggagagcccgtaccggaaccgctctgtggaggagaacttggagctttttgagaatatgaagaacggcgtttataaggacggggagaaagtgcttcgtgctaagattgacatggcgtccccgaatatcaatatgagagatccgattctctaccgtgtagcgcatatgacccatcacaataccggggacaagtggtgcatttatccgatgtacgattttgcacacccgatcgaggatgcggtggagaaaatcacccactccatctgcacgctggagtttgaggatcaccgtccgctctatgactgggtagtcagggagtgcgagttcgttcacggaccacgtcagatcgaatttgcgaagctgtaccttactaacgtggtgaccggaaagcgctatattaaaaagctggtggaagataagattgtggacggatgggacgatccgcgccttgtctccatcgcggcacttagaagaagaggatttacaccagagtccatcaaaatgtttgttgatctctgcggggtatcaaaggcacagagctctgtagactacgcgatgctggagtactgtatccgtgaggatctcaagctgaaacgtccgagaatgatggcggtgctggatccgatcaagctggtaattgacaattatccggaaggagaagttgaataccttgaggcggacaacaacctggaaaatgaggcactcggaaaacggaccgtgccgtttagccgggagctttatattgagagggaggacttcatggaggagcccccgaagaagtatttccgcctctttccaggcaacgaagtgcgcctgatgaatgcctactttgtaaagtgcaccggatttgagaaagacgaggacggcaatgtgaccgttgtacactgtacctatgatccggagacaaagtgcggaagcggatttaccggacgaaaagtaaaaggaaccattcactgggttgcggctccgtatgcggtaaaagcaacggtgcgtctctatgagaatctgatcgacgaggaaaaaggcgtttacaataaggaggatggttctctgaatctgaatccgaactctctggaagtccgggagtgctatgtggagccgaatttccagaatgtcaaagcgtatgacagtttccagtttgtgcgccagggatatttctgtgtggatgcgaaggattccacgccggacgctctcgtatttaaccggattgtttccttaaagagctctttcaggcttccaaagaaataggaatcaagatgaacgaattgacgatgaatttggaaccgcacagtgcggttccgttgtatgaacagatttaccgatatatcaaaagtgacattcaaaaagggaggatttccgcaggggaaaaactcccttcaacccgttctttggctaaatatctggaggtcagccgcagtacggtggagttagcttacgaacaactggagtcggagggctacatcgagtctctcccatataaggggaccttcgcattggacgtccaggagctgtatcggttaaagccgcgcaaaattgcctcacagacaaagcccgcaaagaaacaggagattctctacgatttttccccccatggagttgatctgaaacgttttccctaccaggtgtggagaaagctttccaaggatgtgctcagtgaggataagtcggagctgttccggatgggagatccccagggcgaatgggggcttcgcagggcagtagtttcctatctgtaccatgcacgaggggtaaactgtacaccggaccaaatcgtgatcggtgccgggaatgactatatgctctttctgctccatgtgattttggggcagcagcacaaaatcgcctttgaaaacccaacctaccggcaggcgtaccgcctttttgagagactgggatatccagtgtgcacggtagacatggatcaatatgggatggaggcgaggattttacgggagacggatgcggacatcgcttacgtgatgccgtcccatcagtatccgctcggtattgtcatgccaatcaggcggagaatggagcttctctcatgggcggatgaagcagaggggcgctatctgatcgaggacgactacgacagtgaattccggtataaagggaaacccatcccggcactgaaaggatatgatgcctcggagaaagtgatctatctcggtactttttccaagtccattgcacctgccatccgaatgagctacatggtactgccggagcgtctgcttcgtgtgtaccaggagaactgccgcttcatcaacccgaccgtttcaagggtagatcagatgatccttcagaaatttattgaggaaggctattacgaacgccatttgaaccggatgcgggcgctctacaaagggaggcacgatacgttcctgaactgtctgaaaccgtttgccaagaagtgcaggatttccggagaacatgccggggtacatctgcttttgacgttcacggatggacggacggcagaagagttgatccgccttgcgagagaacagaaagtggcagtgtacgccttgtcctcctacgacacccagggcagccacaggcatgaggcgtccgttctgctcggctatgccaatatggaggaggatcagatcaaagaggcggtggagattctgaaacaggcatggctgtaaaatagaaaaaccggaaacagataccggtggcggtctgtttccagctttttgagggttggaaggtttatgtttggattcatagttaatgtccttaactattacaatactaactatactggaaaaatatgaaaggattgtgtacgccgaataaaaggattctaaaaatacaaaagaaactcttaaaaaattctttatccattgaaaactttatcgggagatcgtaaatccgcgtccgcctacatagttgacattgtcgatcacggtaaaagcggtcggatcgatggtataaatcatcttttttacatcattgatcttgtgatacggtaaaatggtgaggattaccttagccggatccaggtgatatccaccctctgcatggaggaacgtaagcccaagatcaaaggtatcaagaagctcctgccggatcttttcgtgctctgaggaaaagatcagaagctgaacttccgaacgtccgtaggtgatgaccttgttcaccataatactggtgcagagaatgacgatgattccatagaccgtctgtaaaagcggtttggacactgcctgtaagaggatgacggtacagtcgcatacatacatgacaacagaaaccgggatcttacatttcttattgagtacgactcccagaatatcaaacccgccgctggaaccgttcgcccgtaaaatgataccgcttccgattccgagaaggcatccggagagaagactgcttagaaacgggtctttagcaagcggtaagaataagtcaatttgggaaaacacgtccagaagcactgggaaaaggaaggtcataatcaaagttttcaagataaattcttttccggcaaaaatccagccaatgacaaacagcaggatattgattccaaacacaatccaggaaagcggcaagggaattccatgctggagaatgacggaaagacctgtcacaccaccggccacaaagttctgagggaggatgaagagaccgaaagcggcggctgtcatcgtgcctcccaggacaatcagaatgtaagataaaatatgtttcttcatatcaaaacctccgaaaaatagaatgtttgcaactgtaatctatgttacaatttccgccggaaaccgtcaagcaaaaaagacggagaattcgagagatgaaatttgacggacagagaaaggagaacaacgatgaaaaacatacttgtgacgggcggaacggtgttcgtcagcaaatatattgctaaatattatacttccttaggtgataaggtccatgttttaaaccggaatcaccatccacagccggagggaacatatctgatcgaggcggatcggcatcatctgggggaggtactcaagaattatttttttgatgtggttctggacatcaacggatatgacaggcaggatgtctctgatttgcttgatggtctgggagagtttggagattatattttcatcagctcgagcgcagtgtatccggagcatctgccgcagccctttgaggaaacgatgaaggtaggaccgaatcggtactggggaaactatggaactgacaagatcgaggcagagcaggaacttctcaaacgggttccgggagcctatattctgaggccgccgtatctgtacggtccgatgaataatgtataccgggaggcttttgtttttgactgtgccatgcaggacaggatcttttatcttccacaggatggcagtatgaaacttcagtttttccatattcatgatctgtgtaagtgcatcgacagcattgtaaggctgcacccggaggatcatgtatttaatgtaggagacgatcagattgtttccattcgcgagtgggtggatgcatgttaccgtgtggcaggaaaagaagcacactatgtttccgttccagagtcagtgaatccaagagagtattttagcttttacaattatcaatatatactggatgtaaggaggcagaaagaactgctggatgcgccgattccattgacagaaggactaaagagttcctatgaatggtacagaaagcatccgcaggacgtcaaaaagatggaatatctgaaatatatcgatgaacatctggcagaaaaagtagaagagtaatccaaaatttccaggaagggacaagttggctgtacaggaatggcagggagaaggacgggcgttgacctgctcggtaaaattggaatgtcgaaagccggacgaaataccattttataatatgttatcattatattttcaaggccgtattgaacggccttttctaatgtcatccagaggcagtcctggagttgtattaaggacaacgaatacgccattgaacaagagtattggcgtgatataatttggatagaaaataaatcattaggagggtaatatgttatacttaccagaaaatctaaaaaagtatcgattattgaagaatttaacacaagaagatattgctcaatatttaggaattacagcacaaagtgtttcaaaatgggagagaggagaatcctatccggatattacttttttgccggcattagccaatgtatttgaaacgagcatcgatttgcttcttggcatggatacaattcgagctgaagaaacgcgtttgagtattcataaaaaagctgttgcctatcagcgagatggagattatgattcagccgagaaaatatacagagatgctttgctgatatatccgaataaacctggtatgattcttggattagcaggtacattggcgttaaaaggaaatactgatgaagccattgaactaatggaaagaggattgcctctatcaatcaatgaaaaacagaaagcaactatgcgcgcaacattatgttttttatatctgaaaagtggaagagaagataaagcaaataaacttgcatcagaacttccgcacacaagggaaagtagagaagtgattcaaccacttattcagcaaaaattaagtgattttgaaattaatgaaaatataaaagtgattcttcttggagatggaaaggggttatggtgatagtatgaaaatggatttagcttcgctttacaaattgaaaggattgtaaatacaaataggtaataaatttgccgcaaaaaaactgaaagcccaaataaaacaaggcttccagctcagtaatgactagcggagatggtgggagtcgaacccacgcgcccttgcggacctatcgcatttcgagtgcgacctcttacgaccacttgagtacatctccttacttgctgacaaactcagcttatatattataacaaaaaaacagagaaaagaaaagggaaaaaacagaaaaacttgaagttgacttttacacaaagacaactgtctttgtgtgtgagaaaaagacatggacgcacaaaatgtttgccagagacggaaaaagtacttgaatttttacaaaggagggagtattatataaatagaaattatgcagtttgtaaaaagaacggaggaattcaaaaatgagcgataacatgatgtgggcattggtaaaggagaaaccggaagccggattatggatgaagagagtaccgattccggaagtaggaccaaacgatgtaaagatcaaaatccacaaaacagctatctgcggtacagacgtacatatttatcagtggaatgaatgggcacagcatacgattccggtaggactgaccgccggacatgagtatgttggtgaagttgtcgaggtaggtcctggcgtacagggatttaagatcggagatctggtatccggcgagggacacatcacatgcggcaaatgtcggaactgtctggaaggccacaaagaaaactgcaaggacgcaaagggcgtcggtgtcaacagaaatggtgcgtttgcagagtaccttgtgattccgtcttcgaacgtatggccatgcaacccgaatattccggaagagatgtatgcgatttttgatccgttcggaaacgctacacatacagcgctttcctatgatatgcttggagaggacgtgctgatcacaggtgcgggcccgatcggtatcatggcagcggcaatcgcgaagttttcaggcgcaagacatgttgttgtgacagatctcaaccagtatcgtctggatcttgcgacaaagctcggtgcgacaagaacagtgaacttaaaagaagagaaactgaccgatgtgatgaaagagatcggaatgacagaaggatttgatgtaggtcttgaaatgtccggaagtccggctggtctgtctgacatgatccataatatgaagcacggtggaaagatcgctcttcttggacttcagggaacagagacgaaagtggatctggagacagtgatcttcaatggtctgaatatccgcggtatttatggaagaaaagtatgggatacatggtacaagatgtctacgatgcttcaggcaggacttgacatttccccgattatcacacatcgtttcgatatcaaagattatgaaaagggattcgaggcaatgatctctggaaattcaggaaaagtcgtacttgactggtctcatatcaacgattagtagaaaggaagaaaagcaaaaatggcacgtaaaaatgatctgttaagcatttatacaaaaactgtagatgaaattaaagaagcaggccttttcaagggagaggctccgatctgctctcctcagggagcaaaagtgacgctggaggacgggaaagagtacctcaacatgtgtgcaaacaactatctgggacttggaaataatcagagactgatcgacgctgcaaagcgtacatacgatgagagagggtttggtgtcgcatccgttcgttttatttgcggaacacaggatatccacaaacagcttgagaaaaagatctctgattttcttggaacagacgatacgattctttattcttcctgctttgacgcaaacggtgggcttttcgagactatcttaaaagcagaagatgctgtcatcagtgacgaattaaaccacgcttctattatcgacggcgtgcgtctttgcaaagcaaagagataccgctacaaaaacaacagcatggaagatctggaagcaaaattaaaagaggccgatgaagccggagcaagaattaagctgattgcgacagacggtgtattctccatggatggtatcattgccaacttaaaaggtatttgtgatctggctgacaagtacaatgcacttgttatggtagacgacagtcatgcggttggattcgttggcaaaaagggccgcggtaccgcagaatactgtggagtagaaggccgtgtagatatcattacaggaacacttggaaaagcactcggcggagcatccggcggatatacatctggccggaaagaaattatcgacctgcttcgtcagcagagccgtccgtatctgttctccaactctcttgcaccggcaatcgtaggcgcgagcatggagctgtttgatatgttaagtgagagtacggagcttcgtgaccatttggaagaagtgacatcttactatcgtcagaaactggatgagaacggatttgacgtaattcctggaacacatccatgtgtgccggttatgatttacgacgagaagacagcggctgagtttgcaaagagaatgatggaaaaaggcgtttatgttgtagcattttcttatccggttgtaccgaagggaaaagcaagaatccgtactcaagtatgtgcaagtcatacaaaagaagatattgattttatcgtaaaatgctttatcgaagtacgtgaggaaatgggactgaacaaataactttatattgtgtagccatgatagcagaaaggcgccctgaggggcgtctttttgcatgagaaaaggtacagaatttcatacacaaacacgatagactttatccggaaaatcacttgcttttttatatataaggagtataatgataaagatttcataaagattacattaatttttcgtttacgcaggaggaaacatgaatatcatcattgtaggagccggaaaagttggaatcacgattggagaacagttaagctctgaaaatcataatattacaattattgacctgaatcagaagaaagtagaagaggcggaggagaagtttgacgtcatgggtgttgtgggaaacggcgccagttaccaagttcagatggaggcaggcgttatggatgcggagcttttgattgcggtgacaggtgcggacgaactgaatctgctctgctgtctgattgcgaaaaaggccggaaagtgtcagaccatagccagagtcagaaacccgatttacagtaaggaggtcaattttatcaaacggcagatgggattgtccgtggtaatcaatccggagctggcagcagcacaggagatttcaaagcttcttaggctgccatatgctaaaaaagttgatacctttgccagaggccgtgtggagatggtgaaattccggatgcatccggaattacatatggacggactgaaagtggccgacattctttccaagatgaagtgtgacgttatgatctgtggcgtggagagactgaaagagagaaaagttgtgatcccgaacggagatttcatccttcgggatggtgatctggtttctatgatggcggttccgagagagacggcgaagtttttcaagaaaatgggaatcccgacgcatcaggtgaagagtacactgatcgtaggcggcggaatgatcgctttttatctcgccaagcagcttctggaaatgcgggtggatgtacggatcatcgagcagaataaagagcgctgcgagatgttgagtgaggagctcccggacgcgacgatccttcagggggacggaacggataaagagtttctgctggaggaagggctggcacatacggagtctcttgtcgccctgaccaatatggatgaggagaatttgatgctggccctgctggcaagaaaatattctgaggccaagctggtagcaaaggtcaaccgcatccattttgaggaggtgatcgacgacctggatatcgatagtattatttatccgaaaaacctggctgcagagcacattgtgcgttatacgagagcaatgcagaactctcttggaagtaatgtggagactctttataaagtcatggacggagcggctgaagcgctggagttcgttatccgggaggaatctcatgtcacgaaccgcacgctgagggagctgtcgctcaaggataatctgcttgtatgttatatcagccgatttggaaaattgaaaatggcccgtggacaggatatgctgaaagtaggcgattcggttattgttgtcacgacccataaagggctgaatgatattacggatattctgaaatattgaatgccggagggggaaaaggagtaagactatgaattattctatggtattgtatgtcgtagggtggattctcaattttgaggccgcttttatgcttccttcctgtctggtagcctgcatctatcaggaaaaaagcggtctggcctttgtagctgccatggtggttgcgcttgtggtcgggattccactgacgatccggaagccgaagagcagagagttttatactagggagggctttacaagtgtagcccttggttggattgtactgagtattgtcggagcaattccgtttgtactaagcggatctattccgaatatggtgagggcactgtttgaatctgtatccgggtttacgacgaccggttccagtatcctgacagatgtggaggtggtgccccgctgcgtactgttttggagaagctttacgcactggatcggaggaatgggagtccttgtctttatcatggcggtcatgcccttgatcggaggtaaaaatattaatctgatgcgtgcagagagtccgggaccgtctgtcacaaagatgacgtcccgcatcaagaatacggcgaagattctttatcagatttatcttgtaatgaccgtgatagagattcttcttcttctgatagggaagatgccgctttttgatgcacttacgatttcctttggcacggcgggcaccggaggattcggaatcaaaaatgacagtatagcaagttattctccatacttacagtatgtggttacaatttttatgattttatttggggttaactttaacttttattttctgctgcttttgaaaaagccgatcgaagccttaaaaagcgaggaggttcggtggtattttggcattattgctgcatcgattctggtgatctttgtttatgtccggtccatctatccaactgcggaggaggcgttccgtcattctgcgtttcaggtgggatcgattatcaccaccacgggatttgccacgacagactttaatctatgggcacaggtaccgaggacgatccttgtcatgctgatgttcatcggtgcctgtgcaggaagtaccggaggcggtatcaaggtatccagaatcctgatccttggaaagacaatcaaaaaggagcttaatcagctcgtacatccgactggaattaagaaacttcagatgaacgggcgtctgatttcccacgaggtgctcagggcggctaatgtctatatgatggtctatcttttgatttttgcatgttcggttcttattgtggcggtggataattttgacctggtgacaaattttaccgcagtggcggcaacattaaacaatgttggtccaggtctggaattggccggcccgacaggcaatttcagccaattcagcaaccgctcgcttctggtgatgatttttgatatgctcgccggaagactggagcttttcccgcttctgctgttattccatccgatagcatggagaaagttttagcgtgtaaatcaggattcatcgagagagtgggagggacagcatttttagccgctgtcccttctctttgtaagatgtacagaggaaagtgtcattcctatccgaaggatgacagcagcatatcgatggcgtccagaagcaatgctttttcctccggaagatgaccttggatcgtgtaagtattgaggacggtggtgtcgtggaacatacaatctgtcacagccagattttcaaggagaattcgctcttcccacagcatttccgcatcgttcatcatatcaaaatgtcccttttttacatctttataaaggggagtatcttcccagagcttaagtttcaggcaccaaatatccgcaggatgaagctggtttaacagtcttgcggtggacaaggcgtgatggacggaaaagtgccgtcccccgagtcctagaatgatggtgacatagtattcaattcctacgtcttccagtctgcgaagctgggtcagcatatccatagaggtgacgccttttttttgttccaagaggatagagtcgctgccgctttccagtccgatatggagtgttgtaagtcccatctggtgaagaaatcgaagctcctcgtcagttttccgcgcaatatcgtctatccgggaatacatggcaaattcgtggatatttggcatgtactggtctgtcatatcaaaaatcacgctcagcttttcatagtccagaacaaacgcattttccccgagcaggaagagccggtaggcatcaggccggaactgtcccaggatctgcatgttacggcggattctttccagggaatggatatggaacggatctttagcaaagtcgcagaagcggcatttggcgtggctgcacccaagagccacctccagagcggcgcttttctgttcgcttggcggcagatagattgtgtcatgggtatagatagaagcaaataattcttcttctgtcattataggaccccctttctttgaaaagatactacaggaagataaatcagcgggtcagaccgctaagcatctcaaaaaatcccgggtaggagacatccacacactgctcttcctggatgtgggtttctccctgggcagcaaggcctgctacggcaaaggccattgcaatgcggtgatccatatgaggatggatcgtagcgcctgctaatggtttcccaccgtgtatgatcatgccatcatcggtcggtgtaatgtcagcgcccatagcccgtaagttttcagttacagtttgtatccggtcagtctccttgactttcagctcagcggcatcccggatgatagtggtgccgtcagcaaaggcagccagaacagcgatcattggaatctcatcgatgagcgttgggatgatggagccttcaatacaggtaccggtaaggctggaatgacgcaccagaaggtctgcggtcggttcgccggcgccatctttttgattcatgtaagtgatatcagcgcccatggacttgcagactttgaggatgccggcgcgggtgtcgttgattcctacattctggatgagtacctccgatcctgggaccagaagtgccgccccgataaaataggcagcagaagaaatatctcccggcacgaaaatatcctgggcgtaaagctcgtcacatggtgagatggagctttcggcttcgccgccttccagaagcgttgtgtgaagaacagcgccaaactgagagagcatcagctcggtatggtttctggaaagagaaggttccaggatggtggtcggactgttggcataaagccctgccagcaaaatggcggattttacctgagccgacgccaccggggattcatagcggatgccgtgaagacatggttgtccctgaatcatcagaggggcacagtcattgccggacagactttcgatccgggctcccatcatggaaagggggcggatgatccgtcccattgggcgggagttgagtgagtcatcaccggaaaggaatgaggtgaaggactgtgcgcttaaaatcccggagataagccgggttgttgtaccgctgtttcccacattaagagtgccagacggggcagtaaggccgtgaatccctttcccttggacgagaatccttccgtcggtttcttgctgaatatctattcccatctgccggaaacaaccgatggtagagaggcagtctgcaccgttcaggaagtggcggacggaagtggtacccttcgccagggcaccaaacataatgcttcggtgagaaatagatttatctcccggtatcgtaatctccccatggagcggggaggaagttttgatctgtttcataagtagtctcccttatcatatttttccttattctaatcaggatcgttcatagacaatgtagcgatgccgccttaatacctgtgctgcctgttcctgtgccgatgcctcgtagaattcgatacgcagaacgccctcttcaaattcgcggttgtggacgatcccgatatttttgatgctgatcagattggaggccaggatcgtggcaattgtcgcgattccgcctgtctcgtcgatgatatcacagtagatggcaaagagcttcttgatcggtccggcggagatatccggcacggaatttcgatagcttctggaggaatcaaagaagctgtaaatcccctgggaatcaccctgatcgatcatggcttttgccatgttcaacgactcgatgtagtttccgagaatctgggagatatgttccctgtttgccgtcaggatatgctcccacatggttggggaggaggaggcgatcctcgtgatatccttaaacccgccggcagccagaagcttcatcagttcgtccttcgtgtcgtggtcccggacgaaattgacgaggctggatgcaatcacatgggggagatgactgatggtgcccgtcacatagtcgtgggtcttacagtccagtgcaaccggaatggcccggagcgattggataaagtcagaaaacgcctgcaccttttctttttgctccggttcggacggagtgagaatatagtaggaattctcaatcagtaccgacttagaattggcgtagcccgatttttctgatccagccatcgggtgaccgccgataaagaaatcagaaagaccaattttttctacttcctcatggattggtgttttgacgcttcctacatcggtcaggatcgtctgctttgacagaaatggctttacctggcttaaataggcagaattatatatgactggcgcgcacagaaaaagatagtcgcatcctttgaaattttcgtcaatgacagtgaccgccgtgttgatgacggattctgcggtggcaagtgccagcgtttcccggtttttatcaaatgcgataatttcgctgtccggataatactggcggatggcttttgcgattgatccgccgatcagtccaagcccgataaatcctgttttcataattgagttctcacctttcctgatctggttatttccttatattttaagagatttttgtgtctttgtcaaaatacatctcaaattgctgtacaaaatgattagaaaaggaaggacagaacgccaattcaggaatggggtagcctgatcctgatacaagtatcaatcaattccgtccatccatgatagttgaactgttacaaaaacattgtgaatattcaataaaagagttgtaaaataactaaaaatttagtacaatatacacatggttactgtgaaaacaaacgcagtaaaatcgagctagacaatgaaggaggcagcactatatgaaagtttacaggacggatgaaatcagaaatgttgttttgttaggtcatggcggaagcggaaagacgagtcttgcagaagcaatggcctatgtatcaggcgcagtaaacaggatgggaaaagtaggcgacggaaataccatcagcgattttgataaagaagaacagaaacgtggattttctatcggaacaagcctgataccgatcgagtgggagaaggcaaagattaatgtgctggatacaccgggttacttcgactttgtaggagaagtagaagaggcggtcagcgttgcggacgcggcagtgatcgttgtttccggaaaggcaggcgtggaagtcggcactgaaaaggcatgggatctctgtgataagtacaatcttcctcgtatgatctatgtgaccgagatggatttagacgatgcaagtttccgtcaggtagtggaaacgctccgtgagaaatacggtaaggtgattgcgccgcacttcatgccgatccgtgaaaatgagaagcttgtgggctatgtcaacattatcaaaaacgcaggacggcgttacaccgatatcggtaagagagaagaatgtgagatcccggattactgtatggactacttgcagcagtacagagaggcgctcatggagtctgtagcggagacaagcgaggagtttctggaccgttatctctccggagaggagttctctgtggaggagatccgttctgctatgcgtacagaagtcatggatggtgacatcgttccggtggcaatgggatctaatatccaggctcaaggcgttgcgaatctgctttctgacattgtacgttttttccctagtccggcaaaccgtgagtgtgtcggcatgaaccgtaagacaaacgcgatctatgaagcgaactatgactttgctaaagcaaaaagtgcgtacgtatataagacgatggtagatccgtttattggaaaatattcctttatcaaggtatgttccggcgtgatcaagggcgatgatgtgctgtataatgcagatacagacgcagaggcaaaaccaggcaagatctatacgatgctaggcaataagccggtagaagtctcagagctgtttgcgggagatatcggagccatcgcgaagttgacaacaacaaagaccggagacaccctctccacaaagaatactcagatcacattcgcaaagacggaatactctcagccgtatacttatatgaaatatacgacaaactctaagggagatgaagataaggtatcccaggcactctccagaatgatggcagaggacgtgacgatgaaggttgtcaatgatacagaaaacagacagatccttctctacggtatgggcgatcagcatcttgaaattatcgctagtaagcttgcctccagatataaagttgcgattaccctagagaaaccaaaggtagcattccgtgagacgatccggaagaaatccgatatcgactccaagtataagaagcagtccggcggacacggacagtacggacatgtcaagatgacattcgagccgtccggtaacctggaagaggcatttacatttgaagagaaagtcgtaggaggagcggttccgaagaattacttcccggcagtagaaaaggggcttcaggaagcagtattgaaaggacctcttgccggatatccggttgtgggcattaaggcgacattatacgatggatcctaccatccggtagactcttcagaaatggcgtttaagactgctaccatccaggcatttaagaaaggtattatggaggcgtccccggtactgcttgagccgatcgtatctttgaaagtgacagtgccggatgaatataccggagacgttatgggagatttgaataaacgtcgtggacgggtacttggtatgactccggtcaatggaggaaaacaggtgatcgaagccgatgttccgatgatggagctttatggctattgcacgactttgcgttccatgacaggaggacgcggcatctatgaataccagtttgcaagatatgagcaggctccgaacgacgttcaggaaaaagagattgcaaacagagcggcagaggaataaaagcctgctgaagagtgcagacgagacgaaaagtaataaaaagagactttgagatcaggtacataagaaagggtccggtactacgaaaaggaacgtagtgcgggacccttgttttccccgaaaaagagtgctataattgctattcataaccagatattttaacaacaagaagaggagacattatgaaaaagacaaaaacgaaaattttgacagttcttgttctgattttactggcgggaatctattattatgtcaagcttccggcgattaatatccatgcggatggcttctggatgttccttctggtggtgatagcggcggtggctgtcttttatatcggacggcggagactattccgcaaagaggatatcaaggcttctgggatcgcaaaagggctgattgggctatttcttctggtagtagcggtatatctggcagggacgttgttgtcctccccgattatcaatgccaagaagtaccagaagcttcttaatgtagagaatggcgattttcagacggacatcaaggagctttcttttgatcagatcccgcttctcgaccgggattctgcgaccctgcttggaaacaggaagatgggaagcatggtggatatggtatcccagtttgaggtggatgagctctacagtcagatcaattaccaggataagccggtgcgggtatccccgcttcgctatgccaatgtgattaaatggtttacgaatcagtccgaaggtattccggcatatatccggatcgatatgacgactcagtctacagagcttgtcatgctggacgaaggaatgaaatactccacaagcgaatatttcaaccggaacattcaccggcatttgcggttccggtatccgacctacatctttggagagctgagttttgagattgacgacaacggagttccgtactgggtagctccggtgaagaagtttaatatcggactctttggaggagagacggtcggacgtgttgttctttgcaacgccatcaccggggagacagaagattatgcgatcgatgaagtgccggagtggattgatcatgcatacgatgcggatctgctcgtacagctttacgattattacggtacactgaaacacggatttttcaacagtatcctgagccagaaagactgtctcaagacaacagatggttacaactatctggctattgatgatgacgtctgggtttataccggagttacgtcggtgaacgaagatcagtccaacgtcggtttcgttctgatgaatcagaggacgatggagacgaagttttacgaggtagagggagcgacagagaattctgccatgtcctcagcagagggccaggtacagaacctgcattataaagcgacattccctttgcttctgaatatttccggtgaaccgacatactttatcgcactcaaggatgacgcgggactggtgaagaagtacgccatggtcaatgtacagaaataccaggtagttgccattggtgatacggtcagcaaatgtgaagagagctacacagagctcatgcaggaaaatggaattgagacggacgacagcagcgccgcaaaggagacgaaaacgattaccggtgcgattaccaaggtcgcgcagggtgtcgtggatggggattcccatttctacgtgatggtggaaggctccgatgagattttcgacgtatcagtagtgaatttcatagatatcatcaaatacgacgtcggccagcaggtgacgatggagtatcaggaaggagaaaagacgaacgtcgtactttccctcaatggagaagagaaaaatccgattaaagaagaggaagacgaggagaccgacagcaacgacgaggcagcagtcccggaagaaaaataaaaggattctcaagaatgtaaaaaagaaagagacggaaaatcattccgtctctttcttttgtaaacgggacaacgccggatcaggtaaggtaaggactctttcggcagaagtcccgccagccggtgtgattaattcagataagcgcatccctcagcgtcaacgagcctcagttcttcttttcccgcactgatgctcacatagaaatccagatcacattcttttgaaatttttttcagcttttccagaaattccgggatgtcgtcaagagagatatgtgcatgtttcaaaatggcgtcgatgaagatcgccttaatatcgtgatctgcacttgtcataccataaataaacccaagatatgcatcgatgttatcgattgcttcatagtcgtccatgcagattgcacgaatgtcgaaagataagctgtatgtatcgcggtggctcttcttgataaagattacgtgtccatcggactcctttgccgctttgttggcaagttcaatcatctgttgtgtctttccgctgcctttcgggcctgtcaataaattaaccatatgcattatctcctttagctatatatttttcttactgaaatgacttgtgattattatacacccaagagggattttaaacaatccttttttgtcaaattccacaaaacaagctcgaaaagaatgagggaatcttgacaaaaagaacggatgtgggtacaatgaactggtatttaaagaagtagagaaaaacgatcgatgaggaatagtaagggctgatgttttttcagagagtcgccggggggtgtgaggcggcaggacagacgctcccaactcgcctcggagttcttccggtgaagaaagtagccgggagcggttagtcccgttacagacgagagggcgtcggttcttatggaagcggcgaagaagagtggtaccgcgtgagcttttgctttcgtctcttgcagatgtcagagacgaaggcttttttattgtattcatgtagaagcgagcgaaggcaaagatttgaaaattcaaagtattctaatttattaaggaggaaagagaagatgccgacaccatataatcacaaggcaatcgagaaaaagtggcgtacacgctggaaagagcatccggtgaatgttcaggaagacgagagaggaaagcatgagaagtattactgcctcgacatgttcccatatccgtctggaaacggtctgcacgtaggacactggagaggatatgtaatttccgatgtatggagccgttataaactgctccaaggttactatatcattcatccgatggggtgggatgcgttcggccttccggcggagaattacgccatcaagatgggagtgcatccggcgaaatcaacagcagaaaatgtaaaaaatattaagagacagattaatgagattgcggctctttatgactgggacagagaggtcaacacaacggatccgaatttttacaaatggacccagtggatctttgtaaagatgtttaaggcaggactcgcttacgaaaaggagttcccgatcaactggtgcccgtcctgtaaaaccgggctggcgaacgaagaggttgtcaatggaaaatgtgagcgctgtggtacggaagtgacgaagaagaacctccgtcagtggatgctcaagatcacccaatacgcagagcgtcttctgaatgatctggataagcttgactggccggagaaagtaaagaaaatgcagacagactggatcggaaaatcatacggtgcggaagttgattttccggttgatggaagaaaagaaaagatcactgtttatacgacaagaccggataccctttatggggcgactttcatggtacttgccccggaacatgctctggcaaaagagcttgcaaccgatgagacaagagaagcagtagagaaatatatctacgatgcgtccatgaaatcaaatgtagaccgtcttcaggataaggagaagaccggagtctttacaggaagctatgccatcaatccgatgaacggtgcgaaagtgccgatctggctgtccgactatgtactggctgattatggtaccggagcgatcatgtgtgtaccggcccacgatgaccgtgactttgcatttgcaacgaagttccatattccaatcatccaggtgatcgccaaagatggaaaagaaattgaaaatatgacggaagcatatacagaggcttccggaaccatgatcaattctggagaatggaatgggatggagtctgctgtcctgaaaaaagaagccccgataatgatcgaagagaaaggcattggaagaaagacagtcaactacaagcttcgtgactgggtattctcccgtcagagatactggggagagccgatcccgattgttcattgtccggactgtggagccgtaccggttccggaggatcagcttccgctgaccttgccggatgtggattcctatgagccgacgggaaccggggagtcccctcttgcggcgatcgactcctgggtgaatacgatctgcccggtatgtggaaagccggcgaaaagagagaccaacaccatgccgcagtgggcgggttcttcctggtatttccttcgttatgtagatccgcacaataacgaggaacttgtttccagagaaaaagcagacgccatgcttccggtcgatatgtatatcggtggtgtagaacatgcggtactgcatcttctgtattcccgtttctacacgaaatttttgagcgacatcggcgtaatcgattttgatgagccgtttattaagctctttaaccaggggatgatcaccggaaagaatggaatcaaaatgagtaagtcgaaaggaaatgtcgtatccccggatgatcttgtgagagactacggatgcgattctttgagaatgtatgaactctttgtaggaccgccggaactggatgcagagtgggatgacagaggaattgacggtgtataccgtttcctgaataagctgtggaatcttgtgatggacaacaaagagaaagacatcaaagcgtccaaagagatgcttaagcttcgcaataagatggtgtacgacatcacaacccgtttggaaagtttcagtctaaatacggtgatctccggatttatggagtacaacaataagttcatcgatcttgcaaagaaagaaggaggtatcgataaagagactctttccacgatcgcagtcctcctggctccatttgcgccgcatatgggcgaagaactctgggaagaactcggacacgagggaagtgtattccatgcaggatggccgacctatgatgaagaggcgatgaaagacgatgagatcgaagtggctgtacagatcaatggtaagacaagagcggttgtgacgatctttgcagaagccggaaaagaggaagccatcgcagccggaaaagaggcgatcaaagataaactgaccggaaacatcgtaaaagagatttatgtgccgggaagaattattaatattgttatgaaataatggagaagaaactctcatatttttaaaatggagtaaattgggagtaaaagttgaaagaaaatggagtaaatggcgtggataatgaaacattatctgcgtcatttctctataaaatgatgtaaagaaatgcagaatatgataaactaaatgaaacaaatagattcgaactttatgaggtggtgggactcatgttgaaaataagttttaaagcacagcttatgattgctgcttttatagttattggaggctttgtattttccctatatttcgagaatgatatattttataattttacatgggcgtttgtaggtgttcttttctttattaaccctgtttatcctgaaagtaaggtacatttggaagaagtaaaagcccaaaaagcaatgcgaattgcggcagttgttgttttttttgccggaataacgaacggatttggtgtataacttccggttacaaaattgattatattacaagaaagggaagagtaagattatgaattcgacaaaatgaaaagcaatgggggattgggagtaaggtgaagatgctgtaaggaagcagttttgcatattctttatttttcatatttacatctcgagctgattgtgctatttttaataaagaagttattttgggaggtggcttgatgacggctgtgcgtaaataatagggcaataaattttgatattcatgtaaatggattgtttttttgtcgtgttcatttgcgtatggtgatggcagctacctctttacgagatggtttatttttcgtatataaaatcgtatgatggtgaaagtaccgggggtacttttgactgcaatgacactgacaggatagctctccatgaacgagttatctttttttattgtcctgataaagtgggaacaacagcagaaaagaggaaaggaaatatgaatcgggaaaataaaaaaagaaaatatgaaaaaggttactataaaaatcatccatgcacagaaagttttatttgtaaaaactgtggccgcctcgttgtttcagcgggggcaggaagcaatcaccgaaatcactgcccgaattgcctgtgcagtatgcatgtagatcatgaaccgggagaccgggaatcagattgcggaagtattatggatccggtagcggtatgggtgagaaaaaatggagaatgggcgatcatccaccgttgcaggaggtgtggagcgttgagttccaatcgggtggcggcagacgataatccgatgaaacttatgtccattgccatgaagccactatgttccccgccgttcccactggagcggatagaagaaatgacagcacttatgggaggagatggaaagttacacggatagacaagtaagaagagaatctgcacccgaagctattttatagttttcgggtgctttttcaacttttacttgatgtaagtttgtgctacaataaaacgtagatggaacaaataacatgcagattctggaaaaagaaaggaagagattgtgtgaaaccactgtatcggactatattatttacaattatatttgttctttcgtactgcatcgttttctttttgatgagacacgagatagatctggtagtgcttgcggttctgaccgtcgtgcaattcattctgaattttgtgatttatacggtgctggagaaggtggataagtcctgaaaagggaagaagatacatccggttcatcaatataaagagactgcggctgtagtctttcaaaaaccgccagtttgggaagattattgaaattgatggaagtgtattttggcggaacagaaatttttgtaaaaaaagactttcaaaatccacaggaaacgagtataataaaaaactgtctgaaaaatatgcacataagacaggagaagaacgatgagagaggtatatgtgaatattggttctgtggaaaaggccaaaggactcaacggagttttgagaaaactggagggagatttcgatctggtgcagggcagagctaccattgatgcgaaatcttttctgggaatccttagtatggatttgtcccagactgtgaagctgatcatccatgacagtgactcgatcgacatggcgcttctgaaagaatatatggcataaaatggggccgggagaccggcctttcatttaccattgactaaccggctttcttttttatatgatgagtaaaagatcaccggacggcagatactaagtctgtcaggcggaaaaaggagggatcggtatgcttgctttgacagacgtaaagccaggatgtgagtgtatggttaagtggttctttgcagatagagatatcgaagagaatatgaggtgtcttgggatcgggcagggaagccgccttcaggtggtgagcaggtcgaaaggacatttgattattgctccggagaatgggagacggattgcattgtctgaggacattgcaaagcgaattaaagtatagagagaaaagagcggagagagactgattgagtcagtcctctctgtctttttatattcgcgccggattttgcagatgtagcagctcacatttcatagatggttcttgtacatggaatggccgtatagtataataaataaaaagggctttggccctcagaaagccgcagcccgaagggagaagattgtcatgcaggagttaaataagctggagacattgcgggatattatcgacaaaggagaatacattgtcgctctttgcggatcaggcatgatggaagagtgtggaatccatccgctgaaagaccaggaccgggcctaccggatcgaggagaggtatggacgctccccggagtacctctacacggatgccttttttaatacacgtaccgaaaccttttatgacttttataggaatgaattattggtagatctggagcctacggcttcgacctataccttggcggccatggagcgggcggggaagctcaagtgcattatctcaagtaatatttacgagcttagtgagcggagcggctgccacaatgtcatcaatcttcacggaagtatttatcagaaccattgccagaaatgcggcaaaaagtattccgttgactacatcagacaggcgaggaaggttccatactgtgaggcgtgcggcagagtgatccggccggatgtatctttcttcggagagatgctggacagtgagaagctttccaggacgttggaagagattgaaaagagtgacgtacttttgctgcttggaacatcactgagttccgatgtgttccgcaattacatcaaatgttttgagggaagtaagattgtactgatccataataaggagaaactgatggatgagaaggcggatcttctgatctacgacgaaccgaagaacgtacttcccaaacttggtttttaaagacgggtagaaaaggctgctgtcaggtcacagcagtctttttcttgcattgacgcaaagagcaaaatcccttatcataatctggtaagacttgagatacaaggaaagaaaagacaggagcgatagacatgaatattatcaatattgagcatatcagtaagcggtttggagataaatttctgtttgaggacgcctctttcggggtgcaggagggggataagatcgggattgtcggaatcaatggaaccggaaagtcgacgcttcttcagatgattgcaggggaggatgagccggatgagggtcagattgtccgccagaatggcaaaaagacggcatacttgcttcagagtccctgttttgagggctgtactaccatttcagattacgcatttgctggggatacggacggaggatggaaggtgcagagtaatctgacgaagcttgggatttttgactatatggcagagcttaacactttgtccggcggccagaagagaaaggtagcacttgccaaggtgttggcagaggatgcggacatccttctcctggatgagccgacgaaccacctggatgaagagatgattctctggctggaggactatctgagagcttaccggggcgttgtgttgattgtgacccacgaccggtactttttggatcaggttacgaaccggattctggaggtagacgacggaaagttctacgggtatgaggctggatactccggtttcctggagctgaaagccaagagagaagaaatggagttggcttcagaacggaagaggaagagtgttctccgtatggagctggagtgggcgaaacggggctgtcgggcgagaagcacgaaacagcgggcgagactggaacggctggaaacgttgaaaaacgggaaagcgccggaggcggcaaagactgtggagactgccagaatcagcaccaggatgggaaggaagaccatagaactgcatcatattttcaaaggattcggtgagcggactctcatccgggatctggattatattatactacggaatgagagactggggatcataggtccgaatggctgtgggaagtcgaccttgttaaagatgattgcgaggcagattactccagacgccggggagattgagatcggggagacgatccggatcggctattttgcccaggaggtaccagatatggatacggatgccaaggtcatcgattacatccgggattttggggagtatgtgcagacggaagaggggaagcttagtgcctctgcgatgttggagcgtttcctctttccaccggagatgcagtatgctccggtgtccaagctctccggcggtgagaagcgtaggctctatctattgaatgtgctgatgcaggggggcaacgtcctccttctcgatgagccgtccaatgatctggatatcgcaaccgtgacgattctggaggactatctgaattcctttgatggaattgtggttgtcgtatcccatgaccggtatttccttgacaatgtagcggaccggattttcgagatggacggtcagggtgagattcgtcaatacgagggaggatacacggactatttgaatgtcagactctcaaaagaaaaggcgctgacaaagggcgtacaaaatttccgtaaaaatgaggacagcagttcgaaaaaaccgcggcatacgaagctgagattctcctacaaagagcagaaagagtatgaggagatcgacggagtgattgccgatttggaagaaaagctggagatgttggatcaggagatggtgaagtttgccactaattccataaagctcaccgaactgacgaaagtgaaagaggagaccgagcaagcgttggaagaaaagatggagcgctgggtctatctcaacgacctggctgagcggattgaggcgcaaaacgcaaggtaaggaaatccgtgcttacagcagatcgccatatataaagcgcacaaaaatcttcgttttgaaacaggtttggacccggatttttgtgattttgtgcaaagctgaattgttacataataacgaaaaagatttagtactttacttgacaaaagaaggattcattgttacaataaaaaaacagaacgcactctgtttttagaaaagaaagtagaggtagggtttatgaggaaacaggtttattctttattggtagataacacaccgggcgtactgagccggattgcgggactgtttagccggagaggattcagtatcgacagtattactgccggggtgactgcggacagcagatttaccaggatcacggttgtggcaagcggcgacgaaaggattctttcccagattgaaaagcaggtacgcaagttggaagatgttctggagatcaagcttctcaatgatgaggaggcggtttaccgggagctgattctgatcaagatcagagcggacgcggcactccgtccagggattatcgcgattgcggacgttttccgggccaagattatcgatgtggaaaaggaatcgctgatcgtagagcttaccggcgcacagtcaaaactggaggcgtttttaaatctgctggacggatatgagattctggagcttgcaagaaccggaatcacgggcctttccagaggcagtcaggatatcgctgatgcggaggaaatcctgaggaagagagccgagcaggatgggttcgacagagaatgaagctgaaggggtagttcccctttgacgagctatagtaaaaaacaggaggtagagtacaatgaacaaaccaaaaatttattatcaggaagactgtaatttagcattactggagggcaagaagattgcgatcatcggctatggaagccagggacacgcacatgcccttaatttaaaagaatccggatgtaatgtagtagtcggactttacgaaggcagcaaatccagagcaaaagcagaggctcagggattacaggttatgacaaaccaggaagcaaccagatgggctgacatcatcatggttctgatcaacgatgaattacaggctgatatgtacaagaaagacatcgagccgaacttaagcgaaggcaagatgctgatgttcgcacatggttttgcaatccatttcggacagatcaaagcacctgcaggtgtagatgtagcgatgattgctccgaaggccccgggacacactgtaagaagtacatatgtggacggacagggtgtaccggcgctcgtttgtgtagagcaggatgcatctggaagagcactggatctggctctggcatacggcgctgcaatcggctgtgcgagagcaggtcttctgacaagtacattccagatcgagacagagacagatctttttggcgagcaggcagttctctgcggaggtgtatccgcactcatgcaggctggatttgagactcttgttgaggctggatatccggcagaaaatgcatactttgaatgtatccatgagatgaagctgatcgttgatctgatttatcagagcggttttgcgggaatgagatattctatctccaacacggcagaatatggcgattatatcacaggaccaaagatcgtcacagaagatacaaagaaagcaatgaagaagattctttccgacatccaggatggtactttcgcaaaagactggctgttagagaacaagatcggagcacctcacttccacgcaatgagagcaaaaggtgcacagcatgaatccgaagtagtcggagcagagttgagaaaactctatagctgggcagaggatgataagttgatcaataactagttcctgtatggtctgacaggggcatactcccccctgtcagatttttattgtcatttccatacagatagaattctattttaacagatatttttcaaatgctttatgagggtcaagacgcacttctttaaaaaagagaatgatccagataagaaatgcaggaattgccatatatggcgtaaaaaaataagataatactgccccgcctaacataatggcggaccagacaaaacattggtttctcatgtcacgggcaagtcggggtttgtcatataatgcctgttcctgttttggtaaagtgttaaacccggagacaaatttaacagccttttctttcaatatcgcaaagaatactcctacaataaaaaaagggattacgagaactccgcatgtccagaaaccgatattgatattcatcacaaaacctcctttgcgttcatcaatgacaaaaaagacaccctctgacggtgaggatgtcttttttctttttctataaattaagcgatagaatttacagcttttgcaaggcgggatacttttctggcgcaagtgtttttgtggtaaacacctttgcttccagccttgttgatctcagcgattgctatactcagcgcttctttagcagcagcagcgtctttgtttgcaacggctgtctcaactttcttcacgcaagttttcactttagatttgatcgctttatttctcgcagtctttgtttcagcaactaaaattcttttctttgcggatttaatattagccatgacctacacctccaactttggtaatttcgtttcttgcccttcgtcagagccggacacggaacgatctgacgaagcatactcacttattttatgtcaataaataatttatgtcaatacatatttcggcttttttttgagaaactatggaataaatgaaaaaaagcgaggttttatcatggttgagaagtatagtatccggaccgatctggctttggaggagaaagagcgatttgaagaagagaacgtagaggtccagggcgttgtcctggaggaggagtacgacgaagagtgggaagttcggacgacaacggtcattattaagacagaaaatggagcaaagacgatgggaaagcctgtgggaacatatattacaatggaagcgccaaatcttgccgttccggatgaggcttaccaccgggaaatctctgtaaagattgccgaatgtgtggaaaggcttctgcgccataaatggaaacggcaggaaaagcgggatacaggggaggacgtatcggtgctgatggtggggcttggaaaccgggcagtgacgccggacgctttggggccaagagtggcggacaatctgaatatcacaaggcacatcgtccgggaatacggaaagtatgctatgggcgaggatgaagtgactttggtgagcgcccttgttcccggtgtgatggctcagaccggaatggagacagcggagatcgtaaggggcgtcgtggaggagacaaaaccggaggtgattctcgtggtagatgccctggcagcgaggaattccaagcgtctgaaccggacgatccagattacagacacagggatcaatccaggatccggcgtggggaaccaccgcaatgccatcacagaggaaagcgtcggggttccggtgattgccatcggagtgccgactgtcgtggacgctgccactattgtcaacgacgccatggagaatttgatgaaagagatggaacactcagagacccttaaaggggttggggttgtactgcaaggttaccatgcggcagaaaaatatgagcttgtacggcagttaatttcgcctcatctcaacgggatgtttgtgactccaaaggatgtggacgagacagtgaagcggatcagctttaccatttctgaagggctgaacctgcttttttcagcaaaagagtcgaatggagacagtttggcaaaacagggagaggaacaagattcagtaaaagcgaagggaaaggaaacaaaaggacaggcacataatccgaagaaagcaggcatatagtattaagacacgaaaatttggatcatggttttaagaaagtagagtgaggtatttgagtggaaagatacgtctccatcatcttctgatcggaggagtggtgggtgtgcttggcggatatattattctgggaggctatgaaagttcagcagagtttctacgggcagaaatcggacagacgatccagaaaggggcggaagcaatgtactttccgacccttatccggttcggggaagagccggagggaacagtgggcgagtgggtggcaaagcaggcgatgaagatgacaccccttggaaactacgtaaaggcgaacgaggtcagcgagactcagatcgaggacacggagacttacgaaatgcttctgaaaaaggaagcggaggatgagaacgaagtagatgagaacgggaaactcattaagaagaatcaggaaagtaccacggaagtgccccacgaatctcaggtcaaaggaactgtagacagggagaaactcaaagactacgagtatctgacgagtcacttctatacgattgacagtacgacgatgacgagcccggaagaactgaacgcggagacactgcttgccaaaaatatgaagtttacaaaaaaggacaacgggccgaagattcttatttaccacacccattctcaggagacatttgtggactcggtgccgggagatgataaaacttctattgtggggatcggagactatctgacggatcttctaaacaatacctatcatatcaagacgatccatgaccgtggcgtctacgatattatcaacggaaaactcgatcggagtgaggcatacgaactttcgggggcagcggcggaaaagatcctggcggaaaatccttcgattgaggtggtgatcgatttacatagagatggtgtgaacgaaaatacccacctggtgacagatgtcaatggaaagcagacggcaaaaatcatgtattttaacgggctgtgccggacgagggcgaacggggatattcagtattttaacaatccgtacatccaggataatctggcgttctccctgcagatgaaactggatgcggaggagcattatccgggatttacgagaaatatttatctgaaaggctaccgctacaatatgcagcttgtaccgaagatgcttctgatagaggccggagctcagacgaatacggttcaggagatgaaaaatgccatggagccgctggcagaatcattgaaccgggttctgaacgggtaaaaatataatttcttgaatcgtatgttcgattgtggtacactgttgaaagtaatgaactggcaggaacaccagaagagcataaggagaaaggaagaatacgatggcgaaacatacgacatacgatgcggacagtattgcggtactggaaggtctggaggcggtccggaagcgtccgggtatgtatatcggaagtgtgagtacgaaaggactgaatcatctcgtatacgaaatcgtggataattcggtggatgaacatttggccggattttgtaaaaatattgaagtgacactggaaaaggacggctccgcgaccgttgcggacgacgggcgcggcgtgccggtaggactgcaccagaagggcgtgtcagcggcgcggatcgtctacacgacgcttcatgcgggcgggaagtttgacgactccgtttacaagacaagcggcgggcttcatggggtgggctcctccgttgtcaatgccctttccgagtatatggatgtgcagatcagccgggacggagcgatccaccacgaccgctatgagcggggcgtaccggtggtgaaactggacaaggggcttcttccggtcattggaaagacgaaaaaaacgggaacgaagatcaatttccttccggatggcgagatttttgagaagacgagattccgggaggaggaaatcaagagccgccttcacgagacggcctatctgaatccggagctgacgatttattttacggacaagcggaaagatccacaggaggagatcacataccacgagccggacggactgattggattcattaaggacttaaattccaaaagtgagcccattcatgacccggtgtattttaagggcgaggccgagggaatcgaagtagaagcagttttccagtacgtcaacgaattccatgagaatatccttggcttctgtaacaatatatacaatgcggagggcggcacacatttgaccgggtttaagacgacgtttactacggtgatgaaccagtacgcaagggaaatcggcgtgctgaaggaaaaagacgccaatttcaccggagccgacatccgtaatggtatgaccgccattatttctgtcaagcacccggatccaagatttgaggggcagacgaagacaaagcttgacaatcaggatgcggccaaagcagccagcaaggtgacaaacgacgagattgtacgctattttgaccggaatctggatgttttgaaaaaagtgctttcctgtgcggagaaggcggcgaagatccgaaagaccgaagaaaaagcaaagactaatcttcttaccaagcagaagtattcctttgacagcaatgggaagcttgccaactgtgagagccgggatccgaagaaatgtgagatcttcattgttgagggagattctgcgggcggctctgccaagacggcaagagaacggatgtaccaggctattctgccgatccggggaaagattctcaatgtggagaaggcaagtatcgacaaggttttggcgaacgcggagattaagacgatgattaatgcgtttggatgcggcttctccgaaggatatggaaatgactttgatattacgaagcttaggtatgacaagattattatcatggcggatgcggatgtggacggcgcccatatctcgacgttgcttttgaccttattttaccgtttcatgccggagctgatttttgaaggacatgtctatattgccatgcctcctctttataaggcaatgcccaaaaacggcaaggaggaatatctctacgatgaccgggctctggatgagtaccgcaagacacagaaaggcccatttaccctccagagatacaaaggtctcggtgagatggacgcaaatcagctctgggagacgaccttaaatccgaagacccggatcttaaagcaagtagagatcgaggatgccagaatggcatccagcgttaccgagatgctgatgggaaccgaagtgcccccaagacggatgtttatctatgagaacgccagagaggcggagcttgatatttagcagatgatgatcatacgaaatgaggaagagacatgagtcagaaggaaaaggaacagatcattcgcaccgagtattcggatgtgatgaaaaaatcatatattgattatgccatgagcgtcattatttccagagcgctgccggatgtacgggacggactaaagccggtgcagagaaggaccctctatgatatgtatgaactggggatccgttacgacagaccgtaccggaaatgtgcccgtattgtcggagatacgatgggtaaatatcatccgcacggcgacagctctatctatgaggcgcttgtagtcatggcccaggacttcaagaaaggcatggtgatggtggacggccacggcaatttcggttccatcgaaggggatggagcggcggcaatgcgttataccgaggcacggcttgcgaaagtgacacaggaggcattcctggcagaccttgataaagatatcgtcaactttgtaccgaactttgacgagacggaaaaggagccagaagtactgccggtgcgtttcccgaatttacttgtcaatggggccgaggggattgcggttggtatggcgacaagtatcccgacccacaatttaggcgaggtcatcgatggggtgaaagcctatatgaagaataatgccatcactacaaagcaactgatgaagtatgtcaaagggccggattttccgacgggaggcatcgttgtcaaccaggacgacctggcggagatctacgagaccggaaacggtaagattaagatacggggaaaagtaaaggtggaagatcaaaaaggcggacgcaagcgccttgtgattaccgagattccttatacgatgatcggagccggaatcggaaagtttttaaatgacgtctgctcccttgtagagacaaagaagacgtcggatattgtggatatctcaaatcagtcttccaaggagggcatccgcattgtcatcgacctgaaaaaagatgctgacgtggacaagctcatcaacatgctttacaagaaaacgaagcttgaagatacttttggagtgaatatgctggcggtggcggacgggaaaccagagactatgggacttaggaagatcatcgaataccatgtggatttccagtttgagattaccaccagaaagtacagaacgcttctttccaaggaacaggagaagcgggaagtacaggaggggcttatcaaagcctgcgacgtgatcgatctgattatcgagattcttcgggggagccgttcggtcaaagacgccaaagcctgtttgatgtatggtattaccgatgagatccggttcaggagtaaaacttcggagaagatggcgaagcttctctcttttacggagcggcaggcgaccgccattttggagatgcgtctctaccggctgatcgggcttgagatcgaagctctgcaaaaggaacacaaggagaccgtccgtaagatcgagcgatacgagaagatattgaacgattatgatgaaatgtctgctgttatcatcgaagatctgaaccgtctgaaaaaggaatacggtgtaaagcgccggactctacttgaaaatgccgaagaagcagtatacgaggagaagaagattgaggagcaggaagtggtttgcctgatcgaccgcttcggctatgcaaggacggtagacccgtctgtgtacgagagaaaccaggaggcggcggatttagaaagccgttatatcatcacctgtatgaataccggaaagctctgcctttttacggcggaagggcgtatgcaccagattaaggtactggagctgcctcacggaaacttccggagcaaagggcttccggtggacaacatcagcaattatgacagcaccgcagagcatatcgtcacagtgataagcgaaacggatctggaaggtgagatgttgatttttgtgacaaaggacggactgatcaaacgggtggatggatcggaatttctcgtctccaagcggaccactgcagctaccaagctccaggagggggatgaagtgcgtcagatacttcgtatgaacggacaggattttatcgtacttcagacaaagagcggatacttcctgaaatttatggtgggtgacgtctctgagaagaaaaaaggggcactcggaatcaggggaatccggctgcaaaagcaggactgcgtggaaaatgcctatgtctttgcggagggaaacgagacgaaagtttcctataaagagaaagagatctctctgaatcgtctaaagaccggaaaacgggatacccagggaattaaacagcgaggataaagtttctgaaaagattttattaagaaaagacaccttctttattaaaaaagttcttgactctggtataataccagagtttaagatagaaatagaggaggtgttcttatgttaaagaacaaaatgaaatgaactgttcagaaactgacagaaggaatcacgctccagatgcttttctggattgctattggggcggggatcgctactttcggaatccacaatattcacgagcggactggaatcacggagggtggagtgatcgggatgatgctgttcatccatcactggtctggtttgccggctggttggattacaccggtgctggatgtatcatgttaccttctggcattacggtttttgggaacccgttttatcaaggtgtccatcttgtccacgttctgcgtctccaccttttataatctctgggagcttttcccgtatcttctgccggatctgtcggattatccgctggcggcggcagtctttggcggtatattcgtaggaatcggtgtaggactcattgtccggcaaggcggttccagcggcggagatgacgcattggcgctctctatttccaaggtgacgcattggcggctctcccgttgctatctgttcaccgatttagtagtattggggctttcgatttcctacattccgattattcacatcgtcttttccgtggtgactgtaaccttgtcatcgtttcttattgatctggtaatgatgtacggcagagactcgcagaaaaaaataatcaacacatctcgttccgaacaggaatgttaaaaagaggggttccccctctttttttgtgtttgttaatttcttttaacatttccccataaacaataacaagagttttacataagctttacgagacctggatagaatgaaaaagcggagcagggtatagtatgaaaggatgatacatgaatagaaaatcggaaagagagaaacaaagaaagaaaggggcattttttatgctggagttaaagcatattaagaaatcattcgacggagttccggtattaaagaacatcaatcttgagatcgaagacggagagatcgtttccatcctcggtccatcaggatgtggaaaaacaacactgttaaatatcattctcggtctgacagaggcggatgcgggggaactgatctttcaggagaaagatatcctgcacgtaccgatggaagagagaggtttcaatatcgtatttcaggattacgcactgtttccgaacttgaatgtgaagcagaatattacatacggactgcgtaacaataaaaatctcgccacagtggaagaggtaaacggactgataaatcttctcggattaaaggagcatctggacaagaagatcgagcagctttccggcgggcaaaagcagagagtagcgttggcaagaaccatggtgatgaagcccaagatccttctgcttgacgaaccgttgagcgctctggacggtgttatcaaggaatctattaaggataagatcaaagagatcgcaagagagtatcatttgacaacgatcatcgttacccacgacccagaagaggcgcttaccctctccgacaaggtgctcataatgaaccaggggaatattgctcagtttggaagaccagaggacatcatcaacgcgccggaagaagattttgtaaagaaatttatcttaaggcagctcgaaatcaagagaaacaacattatgatgcttttcagcgaatccgaggcaaaaaggtttcaggtggtgtaacaatgagaaagaagatcaaagaaaaagaaatcaaagggatctatggtatcgcgatcctgctcttcctggcatttttgtttgtaccggtagttgtactcttccagcagtctttggaagggaagacaggattttccctggctcattacggagcgatgcttacccagaaaggcttcgggcttgcggtaagacacagcctggaagtttccattgtcagtgctatcttggcaacattgcttgcgtttttgcttgcctataccgtccactacacaaacgcgccgggaggttataagaaatttatccggctggcagcacagcttccgatgcttctgccgaccatcacatatggatttgctattatttactcctttggaaaacagggacttttgacgagactgttcggcagacagctttttgatatctacggatttaaagggctggtgattggatatgtgatttacaccctgccggtatcctttatgcttctgtctaatacgatgggctatattgataagaaattcatggttgtttcccgaatcatgggggataccccgctaaaatcctttttgcagacaattatccggccgctgctcggcacttttgccacctcgtttgtacagtgcttttttctctgctttacggattacggaattccggaatcggtaggagggaagtacgaggttgttgccacggttctttacaatgagatgcttgggagtatcccaaacttcaataatggagcggttgtggcagtgattatgctcgttccgtcgattgtcagcatcctgctgttaaaatttctggaacggtacaatatccgttacaacaagatttccaccattgaacttgcaaaaaataagatgcgggacgtattgtgcgtcattggttctgctgtagttttgctctgtgtattcgccatctttgcggtaatttttattatgccgtttattcaggaatggccgtaccgggctgtctttactctggggcattttcaggatgtgcttcgggataatacactgacagcagtatataaaaactccctgtttgtagcgtttctgaccgcaattttcggaacaattctggcttacggatgtgccctggtttctgcacgtagcagcctgcggggttctgtaaagcaggtgatagagagtacggcactcattaccaacaccattccgggaatggtgatcggtattgcttatatgctcgtgttctctggaacaacgttgcagaatacatttttcctgatcatcatctgtaacatgatccactatttttcgacgccgtacctgatgatcaaaaacgcgctgctgaagttaaatacttcctgggaagcgacagcgaagcttttaggagattcctggggcaagacattacttcggatcattacaccgaatatgtcctccaccctgatggaagtcttcggatactattttgtaaacgccatggtcaccgtcagtgcggtcatttttatcgccggggcaagaaccatggttatcacaacgaagatcaaagaattgcagtactttatgaaattcaatgaaatctttgtgctgtctattctgatccttctgacgaacctttgtatgaagggagtattattcctcctttcagatagaaaaaaatccgaatcgaaagtgaaaaaggagaaaaacattatgaaaatgagacaggtaactgcaatgatgatggcatgtctggtagcaggctctttgatgcttggaggatgctccgcaggagagtcgaaagcatccggatcttcagacgatcaggtcattatttactccaatgcggatgaagaggcggttgacgtcatgaaagagacgctggacgcgaatggatacgagggagaatatatgttccagacatttggaacgtccgagcttggcgggaagctgatcgcagagggcaagaacctggaggcagatctggttacgatgagttcgttttatctggacagcgcccaggaacagaatacgatgtttcaagatctgacctttgattatacgacgatcagcgagaatgacgcttctgatttctatgcgccgatcacaaaacaggaaggggctatcatcgtcaatacggaactgttaaaagagaatcatctggatacaccgaagagtatcaaagatctggcagacgagcagtataaggatctgatttccgtgacggatattaagagctcttctactgcatggcttctgatccaggcgctggtaagcgagtacggagaagatggagcaaaggatgttctgaaagggatttacgcaaacgcaggagacaacattgaagattccggttccgcaccacttaagaaagtacgtgccggggaggtggcagtcggatttggactgcggcaccaggcagtggcagataaggaagacggacttccaatcgattatgtagacccgacagaaggaaatttttctctgacagagtctgtggcagtcgtggataaagataacggagacaaggcagacaaagccatggagatggcgcagtgcattattgaaaagggaaggaaagcactgcagaaaacctacccgcttgcgatttacgagggcgagaaggattcagacaacaaatccgcttacccgaaagtattctccgagaagcttacggcggacttactggaaaaacatcaggaattatctgaagcctgcaaataaatattgcaggaggtaatattcagacgacagactgtcagaggcgcctttctgacagtctctgcctgcgccttagacgcagaatatatcatatggaagaaaggaataaatacatgaagaactacaaattacttacaccgggaccgctcactacaaccgaaacagtaaaaaaggagatgctttttgaccattgcacatgggatgacgattacaaacagatcacccaggagatccgcagggaacttctgaatcttgctcatgtttccgaagaggaatacacggctgttcttatgcagggcagcgggacattcggtgtggaatccgttttgaccagtgtgatcggaaaagaagagaagcttttgattgcggcgaacggtgcgtatggcaaacggatggtttctattgcagagcacgcatgcattgattatactttgtatgaagaagattttgataaagtaccttgtgcccggaagattgcggagattcttgacggagacggacgcattacgcatgtggcgatggtacatagcgagacaacgtccggaatattgaatgatatctcttccgtggcaaaagttgtaaaagaaagaggcaggacattcatcgtggatgcgatgtcaagctttggcggtgtagacattcaggtaggagagctgggaattgacttcatcgtcagcagcgccaataaatgtattcagggcgtaccaggattttctttcattatttgcagaagagataagctgatggaaagcaagggtaaagcaagaagcctttctctggatctttatgatcagtgggagactatggaaaaggatggaaaatggagattcacgtctccgacccatgtagtgctggcgttccgcaaagcgctcgatgagctgaaagaagagggcggaatcgaaaagagaaatgagcgttacacccaaaatcataagatccttattgaaaacctggcaaaactgggcatcaaaccgtatgtcggagcagatgttcagggaccaattattacgactttttattatccggaaaatcatcatttctccttccaggagatgtatgagtatattaaggagagaggatacgccatctatccggggaaagtgacagacgcagacacattccgtatcggaaatatcggggagatttatccggaagatatggtgaaggtgacagcaattatttcagaatttttaaaggagacaaactaagatgaaatacgaagcagtgatttttgactgggcaggaacaacagtagattatgggtgctttgcaccggtgcaggcctttcttgacgctttccatgagtacgggatcgacccgacgatggaggaggtcagaggaccgatgggaatgttgaaaatcgaccacatccgtaccatgcttcaaggagagcgtatcagcgctctctggcgggataaatatggcagagactggacagaaaaagacgttcaggatgtttatgaactcagcgaaaaaaagattctggagatccttccggactttgcggatccgaagccatacgtgacagagacagtcgcaagccttcgggaaatgggaatgaaaattggctccaccacaggctatacagacgagatgatgtccattgttgtgccaaaagcaaaagaactcggatatgagccggactgttggttcagcccgaatgcggtgggaaactacgggcgtccatatccgtacatgatctttaagaatatggagacgcttgggctttccgatgtgagggcggtcatcaaggtgggagacacggtatctgatatccgggaaggcattcatgcgggcatgaaaactgtcggcattgtggagggaagctctgttcttggactttccaaaggagagtttgacgctcttacagaaaaagagcagagggaacagtacgaaagagccgagaagatctacaaagaagcgggagcggattatgtgatccgtgatatccgtggacttcttgatatcgtaaaataagtccctattcagccaaatatcctgaatagttactgaaataaaaggcaaaaccccttgattttgtcataaaaacgtgctatagtgcatatagttacataagaaatcggcagaagagtggacgttatgttcactcttctttagtgcttggcggttttttattggaatccgggaactttgttccttatattaaacaaagaaaggatgttaggattgtcaaaaagagaagactttgagcaaagaacagaggaattgctgattccgatcctcgaaaagtatgagtttgaactggttgacgtagaatatgtgaaggaggcaggaacctggtatttaagagcttacatcgacaagccgggggggattgcgattaacgactgcgaagttgtcagccgggagctttccgatcttctggatcagaaagattttatcgatgacagctatatcctggaggtgagttcaccagggctgggaagaccgttaaagaaggagcgggactttgcaagaagtatcggtgcggaagtggagatccggacatataggatggtagaaggccgcaaagagtttacaggagtgcttgaagagtacgatagtgaatctgtaacggtttcttatgaagatggaacaaaacagaattttgacagaaaagagattgcactgatcaggctggcatttgatttttagtattatttaggaggaaaggaaaaaatgagtacagaattaatggaggctcttaccatactggaacaggaaaaagacatcagcaaggaaacgatgctggatgctattgagaattccctgatgaacgcctgcaagaaccattttaaaaaagcggacaatattaaaatcgtgatgaaccgggagacttgtgatttcgcagtttatgcggagaagaccgttgtggaggaagttgacgatccagaagagcagattagccttgtgaacgcaaaaatgatggactctaagtatgagctgggcgacattgtccaggtgccgattgattccaagtcctttggccggatcgcgacgcagaacgcaaagaacctgattcttcagaagatcagggaagaagagcgcaaagttgtttacgaccagtacttcgagaaggaaaaggatatcgtgaccggaatcgtgcagcgctatgtaggacgtaatatcagcatcgaccttggtaaggcggatgcaatgctcacagaaaatgagcaggtcaaaggtgaagtattcaagccgactgagcggatcaaactttatgtggtggaagtgaagaatacgacaaaaggaccgaagattctcgtatcccgtactcatccggagcttgtaaagcgtctttttgagtccgaggtgacagaggtaaaggatggcatcgtggagatcaagagcatcgcaagagaggctggatcccgtacaaagattgccgtatggtctaacgatccggacgttgatccggtaggagcgtgcgttgggatgaacggacagagagtcaatgcgattgttaatgagttaagaggagagaagattgatatcattaactggagcgacaatccggcgatacttattgagaatgcattaagtccggcgaaggtgatctccgtggcggcggatccggaggataagacggcaagcgtgattgtaccggattaccagctctctctggccatcggcaaagaaggacaaaatgcgagactggctgcgagactgaccggatacaagattgatatcaagagtgagactcaggcaatcgagtctggagaacttccggcaaactatatggatttgccgatggaagagggcgtatatgagtccgacgtctatgaggatgattacgaagacgattactatgaggacgacgctgtctacgaagaagaaagttacggggatgaaagtgatgaataagaagatcccgatgcgtaagtgtgtcggatgcggagagatgaagaataaaaaagagatgctgcgcgtcattcacacaaaagaaggagaattccttctggacgctactggaagaaagaacggaagaggagcctacctttgcttttccagagaatgttttctaaaagcagtaaagaataagggcctggagcgctcttttaaacaggcgattccaaatgaagtatatgaacagctggaaaaggagatggagcagattgaaacggaataaagttctgtcacttttaggtctggctaccagggcggggaaaataaagagcggaagtttcctgacggagcaggcagtgaaggccggtaaggcttatctcgtcttgattgcgggagacgcgtcggagaatacgaagaaaaaactaagcaatatgtgcagtttttatgaggtcccggcccgattttacgcagatcaggatacccttggccatgcaatagggaaggaattccgtgtcagcgtcacggtgacggatgcgggatttgcagacgagattgaaaaacagctgaaaacagaagaagagagaaattgcatataggaggtagttggatgtcgaaagtgcgagtacatgaattagcaaaagagatagataaaacaagtaaggatattatggaatatctgaatggaaacggggcagatttaaaaagccatatgagtttcctgacagatcagcaggtggaagctgtaaagaagaaattcggaaaagccgctccagccggagatgctccgaagaaaaagaccatcgtgcaggtattccgtccgcagaatacccagggaggccagagacgccagggaggaagaggcggtcagagacagactcaggcaggagcagacagcagaccaggcgcaaatcgcgacagaaaggaaggatctgtatccgctcaggagcgagggcgcgacaataaccgtccggcaaaagaccgggatggcaatcgtccggcaagagatttccgtgacagggaccgccagggtcgcgatggcagagacaaaagagatggaagagatcgcgacagcaaggataaagagcgccagggacgtgatttccgcgaccgtgacggaagagacaaagatcgtcagaaccggagtcaaagagatggtaaggacaaagaccgccagggcagagacttccgtgatcgcgaccgtcagggcagagataatagagacggaagggatcgcgatggcagagacagagaccgtcagggacgcgagcgtgaccgccagggcagaggaggaagagacggaagaaataacggaccatccattccggccccgattgtggcagaacagaagccgcaaaggagatcccagaaggataattataagaaaaaagagtatgaccgtgaggaggagcgggaaggcaaatttagtcaaaagcaaggcaagggaaagaaaaatcagcagcctgtgatggaaaaaccacagccgaaggaagagaaaaaggaagagcagattaaacaaatcacgattccgaagatgctcacaattaaggatcttgcagatgcgatgaagatccagccgtcggcaatcgtcaagaagctgttcctccaaggcaagatcgtgacggtaaatcaggagattgatttcgagactgcggaagagatcgcgatggagtttgatgtactctgcgagcaggaagtagaggtcgatgtgatcgaagagctcctcaaagaggaggaagaagacgaaaagaagatgaagaaacgtccgccggttgtctgtgtcatgggacatgtggatcatggtaagacctcccttctggacgctatccgtgatacaaacgtgacggacagagaggcaggcggaatcacacagcacatcggtgcctctgtagtgaatatcaacggcgagagcattacgtttctcgatacaccgggacatgaggcatttacagcgatgcgtctgcgcggagcctgctctacagatattgcggttcttgtcgtagcagcggacgacggtgttatgccgcagacggtggaggcgatcaaccatgccaaagcagcaggcgttgagattgttgttgccatcaacaagattgacaaaccaagcgcaaacattgagcgtgtcaaacaagagctgaccgagtacgagctgattccggaagactggggcggaagcaccatctttgttccggtatccgcgcacacgaaagagggaattccggaacttctggagatgattcttctcacagcggaaatgttggaattaaaggcaaacccgaacagaagggcaagaggccttgtcattgaggcgcagcttgataaagggaaaggaccggttgcgactgttctcgtacagaaaggtacgcttcgtgttggagatgctattgccgctggatctgcgttcggtaaagtcagagccatgatggacgataaaggaagacgtgttaaagaagcaggtccatccacaccggttgagattctcggatttaacgaggttccaaatgccggagaagtttttgttgtaagcaagaacgaaaaagaagcaagaagttttgcggagaccttcatttcccaaaaccgcatgaagatgttggaggagacgaagtccaagatgtctcttgacgatctgtttaatcagattaaagagggaagcttaaaagagctggatatcgttgtcaaagccgatgtacagggatctgtagaagcgatgaagcagagtcttcttaagctttccaacgaagaagttgttgttaagattattcatggcggcgtcggagctattaacgagtccgatgtcacgctggcatccgcatccaatgccattatcatcggatttaacgtgcgtccggacgcggcggcaaaggagactgcggagagagagaacgtagacgtccgtctgtaccgtgtcatctacaatgccatcgaagacgtggaagccgctatgaaggggatgctcgatccggtattcgaggaacaggttctcggtcatgcggaagtacgtcagacattcaaggcttccggagtcggtacaattgctggtgcttatgtgctggatggtattttcgagcgcgactgttcggcaagaattatccgtgacggaatcgtcgtatttgaaggaaaacttgcttctctgaagcgtttcaaagacgatgtcaaagaagtgaaagccggttatgagtgtggttttgtatttgaaaagtataacgatatcaaagaaggcgaccaggtagaagcattcaaaatggtagaaaaaccaagataggatgaaattatgagaaaaaatagtattaaaaacacaagagtgaatacagaagtgatgcatgagctgtccaatattctgcgcggggggatcaaagatccccgcgtagcagagtttacctctgttgtagcggtggaggtggcgccggatctgaaaacctgcaaggcatatatcagtgtactgggtgatgagaaagcgcaggcggatacaattcggggacttcagagtgccgagggatatattcgcagagaactcgcacattcgttgaatcttcgtaatacccccgagattcgttttgtcctggatcagtcgattgagtacggggtagcgatgtccaagaagatagatgacatcacgaagaggcaggagaaagaggaagaataatatggtaaagctttacgaagtactaaaaggagcaaaacgggccggcattgcgggtcatgtacgtcctgacggggactgtaccggctcctgtctggcgctctaccagtatatcgggctgtattttccagaagttgcagtggatgtgtatttagaggagatcccgaattccttccacatgctgacaggggcggatgagatttgccatggcttgccggaaaacatggtatatgatgtcttttttgccctggactgtggggatgtagggcggcttggatttgcgggcactctgtttgaaaaggctaagaagacggtctgcattgaccatcatgtaagcaatgagtcatttgcggatgtgaaccagattgttccggatgccagctccacttcggaactgatctataatctgatggacaaagaaaagatcacaaaagaggttgcggaagcgctgtatcttggaattgtacatgatacaggagtattccagtattccagcacgaagccatccactatggaggcgggagccgagcttctgcgaaaaggaatcgacggaccgaagattatcgaaaaaaccttttttgaaaagacctatgcacaaaatcaggtgcttggtaaggcgcttttggagagcatccgcctgatggacggcaaggtcatcttttcctatatcacgaagaaaagcatgagctttttcggggtgaaggcaaaggatctggaaggtattgtcagtcagcttcgagtgacggcaggcgtggaagtcgctattttcctctatgagctggaaagtggggaattcaaagtcagcctccgctccaaggaaaaggtggacgtcagcaaggtggcacggtattttggcgggggcggtcatgtcagagcggcaggccttacttttcgtggaaccgtttatgacgcggtcaacaacctgatgaatcagatctccctccagttggaggatggggcatgatccacggaattttaaacgtaagaaaagaaaaagggttcacatctcacgacgtggttgcgaagcttcggggaatgacaaggcagaaaaagatcgggcacaccggaaccctcgatccggatgcggaaggcgtccttcctgtctgtcttggcaaggccaccaggctctgcgagatgatgacggacaaggagaaagcctatgaggcggttcttgtgcttggaaaggagacggacacgcaggatctgggtggtcaaatattgaacgaaacggagacaaaccatctgacgaaagcagaggtggaggaggcgattctttctttcctggggagttatgaccagattccgccgatgtattcagcactgaaagtgggaggcaaaaaactctatgaattagcaagagagggcagggaagtggagcggaaagcccgtcgggtagagattcgttccctgcgggtcctcgatacgcatcttccggaagtccgctttgaggtggtctgttccaaagggacctatgtgcgtacactctgctatgatattggcagaaaattaggatgcggcggatgcatgggggatctgcttcggacaaaatcgggagcgtttacccttgcgatgagccatacactctctgagatcggggagtatctggaatcgggacggatcggggagattctcattcctatcgatgccatgttcccggatatcagaagggtgacgataaaagcaggtcaggagaagtccgtttataatggtaatccgcttcgtaaagggcagcttgaagatggtgaaaatctgtgtcctgaagacggagaacagatccgggtctacggttcggacggaacgttccttgcgatatacatttaccgcagaagccgggagagctatgcggtagaaaagatgttttacagcctagagtaatcagaagcccggaatgaagataaagaggaaagaacatgcaatatattacaggatttgaacattacagagaagacgccgggaccgccgtgacccttgggaaatttgacggtctgcatcgtggacaccgaaaactggtggagcggattatggagcacgtggagcgggagccggatttaaaaagtgttgtttgttttttcgaaatgacggaattcaaaaagatgcgtcaccttgatcagaagaggctgatgctcaatgaagagcgggcgattcgactggaaggaagggtggattatctgatcgaatgcccgttcctttctgtcaaagagatggaggcggagactttcattgaaaagattctctccggacttttccatgccagatatattgtggtaggagaaaatttccgatttggccatgaccggcggggagatgtagcgatgcttgcgaaatttcaggagcggtacggttatcgcctggaagtgattccgaacgaatactacggggagcggattgtaagcagcacttatgtgaaagaggtaatgaagacagggaatatcgatcttgtcaaccgtctgttgagttatccgtatacgattgcgggaaccgtacaaaaaggagccggaatgggacgggaaatcggctatccgactatggacatttatccatgccaggaaaagatactgcctccaaacggagcctatgtctgcaagcttcatgtagatcaggagtggtatcagggagtatgcaatatcggacagaaaccgactgtatccaaggggggagagacgattctttccgtgcaccttttctgttatgaaaagaaagaggaagcaaacggtaaggcggttgtcctccatctttaccactatctgagaccggaagaaaagtttgaggacgtggaggaattaaagtgccagattgaggaggatatctgggaggggaaaaggcattttttgctcacgatggagagcaggcgcgcactgctggagagcgaaacaaaaaagcagaaaaagaattgacatccacaaggatgacatgatatactcaacaagtatgagtgagccgatatccagtggacggaggactccgaccgccgcctgatatccggcgtttcaaaataaaggaggataaagacatgatcgacagagaaaagaaagcagcgattattgctgagtatggaagaagcgaaggagacacaggatctccggaagttcaggtagctatcctgacagccagaatcaacgagttaacagaacatttcaaagcaaatccaaaggatcatcattccagaagaggtcttttgaaaatggtaggtcagagacgtggtcttcttgcatatttaaagaaaaaagatatcgaaagataccgttctttgattgaaagattaggactcagaaaatagtcggcacttcaaaaggggacggaacatcatttccgttcccttttatactgtttatcgtaccggagcttttcggcacctgaaacatgtcatggtcagaaagaccggttgcggggaaatgatccgggaccactgaaaagcataccagcctatggcctgtttttcagtagtttcgggattctccgcagaaaaattatcaaaactagaggaggatcatatgtataagacatttgagatggaacttgccggacgcacactgcgtgttgatatcggcagagtggcaaagcaggcaaatggagccgcgctgatgcactacggagagacgacagtactctctacagctacagcttccgagaaaccaagggaagggattgatttctttccgctgaatgtagagtataacgaaaagatgtatgcggtcggaaagatccctggaggatttaataaaagagaggggaaggcgtccgagaacgcaatcctgacggaccgtgtcatcgacagaccgatgcgcccgcttttcccgaaggactacagaaacgatgtgacgctggagaacctggtactttctgtggatcaggactgcagcccggagctgactgcaatgcttggctctgcgattgcggtatcgatttctgatattccgtttgacgggccgacagcctccacacaggtagggttagtaaatggaaagtttgtctttaatccgacggccgaagaaaaagcggtatccgatatgcagctgactgtcgcgtccacaaaagaaaaggtcattatgattgaggccggagcgaacgaggtgccggaagaagtgatgctcaaagcgatttttgcggctcacgaagtgaaccagaaggtgattgcttttattgaccagatcgtaacagagtgtggtaagccgaagcatgagtatgaaagctttgcggtaccggctgatctgatggaagagatccagaagattattccggcagaggagatggaagaagctgtattcacagatgacaagcagacgagagaggcaaatgtgcgtactatccgggaccgtctggaggagatttttgcggagaacgaagagtggcttccacgtgttggcgaggcgctctatcagtatcagaaaaagactgtccgcaagatgattcttaaggatcacaagcgtcctgacggaagagcgatcaatgagatccgcccgcttgcggcagaagtcgatctgattccgagagtccatggatccgcgatgttcacaagagggcagacacagatttgtaatattactacacttgcgccgctttccgaggcgcagagggtggatggccttgacgagtccgagacttccaaacgctatatgcaccactacaatttcccgtcctactccgtaggagagacgaagccgtccagaggaccggggcgccgtgagattggacatggagcgcttgcagagcgtgcccttgtaccggtacttccatcagaagaagagttcccgtatgcaatccgcacggtttccgagacattcgagtccaacggctccacatctcaggcgagtgtctgtgcatctagtatgtccctcatggcagcgggcgtaccgatcaagagcgcggtggcaggtatttcctgtggattggtgacaggtgaaacagatgatgattatatcgttctgacggatatccagggactggaagacttctttggagacatggactttaaggtggctggtacccacaagggaattacagcgatccagatggatattaagatccacggactgacaagaccgattattgaggaagctgttgcccgcacaaaagaggcgagattctatatcatcgatgaggtgatgaataaagcaatcgcagagccgagaccggaagttggaaaatacgctccgaagatcatccagatgaacatcgatccgcagaagattggcgatgtagtaggtcagagaggaaagacgatcaacgccatcattgagaaaacaggtgtgaagatcgacatctctgatgaaggtaatatatccatttgcggtacagatcaagagatgatggatgaggcaaagcgtcttatcacgattatcgtgacagacttcgaggcagggcaggtattggaaggaacagtagtcagcatcaaagactttggcgcgtttctggaatttgctcctggcaaagagggaatggttcatatttccaagatctgcaaacagcgcatcgaccatgtagaagacgtgcttacacttggtgacaaggtcaaggcagtctgtcttggaaaagataagatgggaagaatcagcttcagtatcaaagacgttgcgccggaaaacagataatgtcattcaatagatttcaaagctcctgtgtctgcaaaagacatgggagcttttttaaaaaagagtatttcactgtagaaggaaaatgagaagagaagtaggaggaactcaaaatggaagaaaaaatgatcagaagatcctgcgtggactgtgcggtgacagcttgcgaaagaaaggatggcaagcgtccggatttctgcctgacaacatcgttgaacccggatcttttacaggaggcgattgcctgttatgaagatatggaagatcagaagcttgctattgctgcggcagaggttgagtatgaaggctacctgaaactgacgcgggtggaggagatcatcgccttttccgggaaaatcggggcgaagaaaatcggaatcgccacctgcgtcggactgatccgtgagagcagaacgcttgcaaaaatattgagaggccatgacctggaagtcatcggagtcgcatgtaaaatcggggctgtagataagacgagaattgggataccagaagaatgtcaggaaattggatgccatatgtgcaatccggttttgcaggcgaagtatttgaacaaggagaagacagatctgaatgttgttgtcggtctctgtgtcggccatgacagtttattctataagcactcggacgcaccggtcaccacggcagtgacgaaagaccgggtactcggtcataacccggcggcagcgctctatacggcagaatcttattacaaacggttgctgtaaataggaaacaagggtgttttgtaccatttaagcccggactttggagtgtatacaatacaaaaagaagcatatcagagaaggggaaagcctgtctgatatgctttttttctatttggactaagatttacagaacgcggtagtacggacagatgtcctcgaaatgaccgtctttcatccggaatccctctgggatcactccgagagatacaaagccgcatcgttcataaaggtgacgggcgtgtatgttggaagcgactactgcattaaattgcatgacacggaaaccatattcttttgcgagttgtaaggagtggagaaccagcttttcgccgatatgaaatccctgtttgtcccttgatactgcataactggcgttggcaaggtggccgcatcgtccgatattgttcggatgaaggatgtaaagtccacacacttcgtccgtgcccgtatccacagccacagcacagtctgtctgctcggcaaagaaagccggcccgcttacatcatctaagagggtctcttgcgggaaagcgatgccatcctccaccacctgattccagatggccgtcatggcagggacatcttcatgtctataagtacgaacttctatattcatctgtcaattctcctccttttcttttttgccccgatagtaaatacgtaaaaccagggaaagaacacttatgatcattgtatcatgggaaatagaaaaacaacatcctttttctgcaccttttgatcatttttctattttatatttatagaaaaaagggagttgttcctagggatgaagtatgttccggttttgttagtcatattttccggttgtccacatatattgtgttgtaaaaggtggtggaaagtagtgagcaataagaaagagcagatttttcggattcttccggagcgattgaagcggatggtggatcaggtgatgatgcaggaagatctggactttgaacaagtgacggagatctgtatccgtgtgggaaagcctgtctgtgtctaccttggagggaaggaagttcgggtgaactatacggctggcagggaggaactgaaggagatcgtaaattacatgagcaggtattcaccctatgcgtttgaggaagagatgagaaagggatttttgaccattgagggtggtcatcgagtagggatggcaggtaaggcgattacggagcaggacagggtccggaatctcaggtatgtctcctcggtacatatccgggcggcacacgaggtaaaaggctgcgcgaacaaggtattcccttacattgccaaccagaaagaattatgtcataccatgattatttcgccgccgggatgcggtaagacgacgcttctgcgggacatcatccgacaggtctccgatgggaacgactatgtgaaaggatgtacagtcggtgtggtggacgagcgttcggagatcgcgggatgctatctgggagcagcgcaaaatgatatcggacttcgcagtgatgttcttgatgcttgtccgaaagcagagggtatgctgatgatgatccgctctatgacgccaaaagtggtggccgcggatgagattgggacgaaagaggatgtggaggcaatcgagtatgccatgcactgtgggtgtcggatgattgtgacagctcacgggaactctgtggaagagctccggcaaaagccggtgctggggcagctcatccaggaggagcggtttgagaggtacattgttttgcgtcagggagacaggcccggtcttcttgatggaatatacgacaggaggggacagccatgtttctgaagctgtttggagccgcctttgtgattgcggggtgctcggctttggggatcgggtacggacggaaattaaatctgcatcttgaggaattgaggttcttaagagagttgtaccggatgatccggggcgaaatccagtacacgaaggagccgtttccggaggtgatgctggaggtgtcctcgcggatcaaagagccgtatgcttcactgtttgtacaggcacaccgtgcctttgaagagcagggaagcttacagtttccccaatggttccgatcctacacatccgggaccttggaatcctaccggagagagcgggggatgacagacgaggagtgggagcagtttctctcccttggcgggcagaccgggtatctggatctggacatgcagatcgggacgcttaagctttccggggaacggtgggagacgtggatccgggaggcagaatcccagatcggaccgaagcggaggatcggaagctgtctgggagtgcttggcggggtgtttttgacgatcctgctgctgtaagaaagaagaagggaaggaagtgcgtatgagtgtcagtctgatctttaaaatcgcggcggtcgggattttggtttccgtgttaagccaggtactaaagcacagcggaagggaggaacaggcatttttaacaagccttgcaggcttgatcctcgttctgatctggattgtgccgtatatttatgatctgtttgaaacaatgaggcgtctgtttgccttgtgacaaatggtacagatacaagtcgcaggtaaagagaagggagggaaagcatgacgatacaaaaagcagcggcggcaggcgtctgtgcggcgctcattgctcttcagtttaaaggcggtaaaacggaatatggaatttacgtcagtattgccgcagggcttttgctggcggcgggaattctggggaaactcgacacggtacttgcgacagtcagggagatcggctctttcttgcagatcgaaggatcttatctgggtgtactcttaaagatgctgggcatcacatatgtggcggagtttgcctccaatatctgtaaggattccggataccagacgattgcatcccagatccagctctttggaaaactgtcggtgttggctttggggatgccggtgcttctgacgcttcttaggaccatcgaggtgtttttatcgtgaggaagaaagaagggctgattcttttgctgctgcttttaggggttctcctggtgtggggatccatccgggcagaagcagcagaagagccggaggaggaaacagtcccggaggccgcaagggaatggatagacgagatggattttcgtgatgtggataagatgatggacgagatctttcagaaagaacagatcgaatttaccgagcttgtggaaacgctgctttccggagatgtgaccggggctcttgcgatggcgggacggggaattggcgggacggtcttttcggtcctttctgaaaacaagacggccatgcttcacatcctcgtcattgcactgattgcggcagtctttgccaatttcagccaggtgtttgcggcggggcaggcggcggatacaggcttttttattctctatctgcttctcatcaccttgctgcttcagacctttgaggtgatgatcgattccgtgacgaaaagtctgactcttttgacggattttatgcaggcgctctgcccggtttatctgatggcggcggctgttgtcacgggaagcggcagttcactggttttttataatctgatgctgttcttgatatatcttgtgcagtcggttgtctgttcctttgtactgcccttgattcatgtttatctgatgatccggttgatggacgaactttcgccggaaccctatttggggcggtttgcggagcttggacaaaccatcatcagttggatcttaaaaacgattcttgtaggggtcatgggggtgaatctcattcaggggctcttaagccccgtgattgatgaggtgagaagaagcggtctgcaaagggggctggagtccattcccggtatcggcaatacgctaggcggaatgacggagattgtcatgtcggcgctgacattgatccggaacggtatcggagtagccggggcgcttatctgtgtgggaatctgtctgattccggtcattcagattgccgtgctggcgctgatttataaactgctggcagcacttttagagccggtctcggactcacgtattatcgggtgcgtggcgggagcaggggatgcggcagtgctgcttttaaagacggtatacacaagcgcggtgctgtttttgattacgattgtgattgtggcggccattcggtcataggaggagacatgtttacatatatatatgactggataaaaaatcttgtcttttatctgattttgatgacaatgctgatgcagatcatcccggattcggactacaaaaagtatattcgcttttttacgggtctggtattaattctccttctggcaagaccggtgtttggaatctttcatctggaagaggaatttgaccgaatataccacagcatcgagtaccaccagaatgtgagggagatggaacgggcaagggaagtgtttgaatctgcggaggagggatatcttgaatgggaacaggacatggcttcagaagcttctggagaacgggaaacttccaatgaagaataaatggcttctggtgcttcttgcagggcttttgcttttagtgattgcgatgcctgtctcagacaagaagaatcaggagacaaaagaagaactcaccaaaagcgataccggggaaaaagaaaagtacgaagattacgccgaaaaagccgcatctgaactggagaaggtgatctcccggatggagggggcaggaaaggtcaaggtgatgatgaccgtttcctcttcctcagagaaggtagtggaaaaggatgaggagacggtggaggatgagaaacaaagaacgaaaaacgagacgaccgtctacgaagagacgacggtgggacagacgccttatgtcaaaaaggagcttgtccccactgtggaaggagtggtagttctctgtgagggaggagatcagccggttgtcgtacaggagattacagaagcggtggaggcattattttctgtggagtcacataagattaaggtagtaaagatgaaataggaaaagcaggaggaatgacggtgaaacgattgattaagaaaaatcaggtgattgtggcggcactcgccctgatgatcgcggcggcagggtatctgaattattcggggaagctgttttcggataaggatgacacgaaaacagcacaacaggcaaacagcgaacttctcgatatttccgaggaggacatcgagaccggatcgggagatattgaaagtcaggatcaagacgcgtctgaaacagacggagatgtggaaggaacaccaggagaagcagtacttacaaacggagaggtcaaaaatactgtggcgcaggcaaaagtatccagagagcaggtgcgggcgaagaataaggagacccttcaggggattatcgacagcacttcagtgacagaagaacagaaacaagatgctatcaatcagatgatagagctgacaaaggttgcggagcaggagtcagctgcggagacactgcttgcatcgaaaggctttaccgaatcggtagtaaatgtcagtgacgaacaggcggacgtggttgttggaaacgtggaaatgacggaagcaaaccgggctcagattgaggatattgtgacaagaaagacaggggttgccccggagaatatcgtgatcacaccgatgagtaagaaggcggatcagaatactgcccagaatgaaaatacgtcgacagagggaaaaacgacagacagcgaggacggcaaagaaacagccgaagaacaggaatagaaatacagggatagctcagtaaagaaagctattgcggattttaaggcggatatgctacaataattaattgcgtggaatcatttggaagattccgggaagaataagaaaaaatacaggagaatatcatgtcaaagattacagatgaaataaaaaagcggagaactttcgccattatttcccacccggacgccgggaagacgaccttgacggaaaagttcttattatatggaggagccatcaaccaggcgggctccgtaaagggtaaggcgaccgcaaaacatgcggtgtcagactggatggaaattgaaaaggagagaggaatttcagttacttcctcggtactacagtttaattatggcggatattgcatcaatattctggatacgccgggacaccaggatttctcggaggatacgtaccggacgctgatggcggcggattcggcggtgatggtgatcgacgcgtctaaaggtgtggaggcacagacaagaaagttattcaaggtctgtgtcatgcgccatattccgatttttacttttatcaacaagatggaccgggaggccatggacacattcgagcttctggacgatattgagaaggagcttggcatcgccacctgtccggtcaactggccgatcggttccggaaaagcgttccggggggtttatgaccggaacgaggaggagattgaacttttcttcgatacgaagaaaggaacgacaaccggagaagtgaagaagattcgtgtggatcatccggatgtggatcagtacctggacccagagcagaaagaccagcttcttggggaaatcgagcttctggacggggcaagcgcaacgtttgatcaggagatggtggaccgtggggagctttctccggtattcttcggatcagccctcaccaatttcggggtggaaacatttttacagcattttctgaagatgacgacttctccgcttccgagacattcggacaaaggggatattgatccgatgacagagaaggacttttctgcctttgtctttaagatccaggccaatatgaataaagcgcaccgggaccgtatcgctttcatgcggatctgctccggggaattcgacgccgggatggacgctttccacatccagggtgggaagaaagttcgtctctcccagccgcagcagatgatggcaagtgagcggaagatgatcgagaaagcttatggcggggatattattggtatttttgatccgggtattttctccattggggatacgatcacgacgagtcaggagcgttatgcttacgaggggattccgacctttgctccggaacatttcgcaagggtacgccaggtggacactatgaagcggaaacagttcatcaagggaatcaaccagattgcccaggaaggtgccatccagattttccaggagttcaatacgggaatggaagagatcattgtcggtgtagtcggcgttctgcagtttgacgttctgaaataccgattgaaaaacgagtacggggtagagattattctggagacgctgccgtacgagtatattcggtggattgaaaatgaggagatcgatatggatcgtctcacaggaacatccgatatgaagaagatcaaggatttaaaaggccgcccattgcttctattcgtacacgagtggagtattcggatgacgctggagcgaaacgagggcttacggctttccgagtttggacgctcataatcaaaaaagacaataggaattgttacagagaacctccaaaatcgtgaacaagagccttgtaagcaacgacggaatttggtataatggatacagtaattgtgtattctatgtacaggaaacatgcagtatcaccgatatgaggaggtttcagatatggggaaagaagagagaaatacctatacgatccaggaagaagagatcggacaggtacagattgccgatgaagtggtggcgattatagccggtcttgcggcgatggaagtggacggggtgtcctccatggcaggcacatctacgagagatctcatcagcaagcttggaaagaagaatctctccaagggagtgaaggtggacgtcctcgacggagtggtgaccgtatctttgtcactgaatttgcgttttgggaagaatatcatggaggtatcttccagggtacaggagaaagtcaaggccgccattgagaatatgacaggtctttccgttgcagatgtcaatatcaaagtcgcaggagttgacgacgatacagaaaattaaccccgcacattgtcaagaataaatatacgatgttatgtgtttttatgcacgaaagattgccggaaggcagaaagtacagtataatgaggggtgtcgggatgatacccctttttttgagttccgggtaaggcgaaagctttcgccgggagaagacagaaaggaaggaatatgggaagatcagaaatcagagaacacattttcagaatgttatttgggagggagtttcatacacaggaggagcttttagagcagggacgactgtacatggagcttttaaaaacggaacgtgaagtcagtgagacggatgaggcgtatatccaggagaagtgtcgtaaggtcgaggaactgattccggagattgacgctctgatcaatgagcagacaaccggatggaagaccggacgtatgaataaggcagacctgacgattttacggcttgccgtctatgagatgaagtgggatgaggacattccggtcaaggtggcgattaacgaggcggtagagcttgcgaagaagtacagcagcgacgagggaccgtctttcatcaatggcgttctggcaaagatcgcggcgtaagagacgatgggaaatgtatatacggtcagtcaggtcaaccagtacattaaaaatatgttcacccaggactttctgttaaaccgtatccatgtccggggggaagtgtcaaattgcaaatatcatccaaagggacatgtttacttttccctcaaggatgaatcagggatgatctctgccatcctctttgcggggaaccgaaaagggcttccgtttcggatgcaggacggccagcaggtggtagtctttggatccatttccacttacgaacgtgacggcacgtatcagctatatgccaaggagattgtcttagacggggcggggcttctgacacagagatttcaggagctcaaagaggagctggaggagatggggatgtttgccccggaatataaacagccgatcccaccctatgcaaagacgatcggcatcgtgactgcaccgacaggagccgctatccgtgacatcattcacattgcgaaacggcgcaatccttatgtaaagcttttgctttccccggctttggtgcagggggaagaggcggcgccaagcattgcggcggcaatccgtcggcttgagaaagaggacgtggacgttatcattgtcggtcggggcggaggctcgatggaggatctttgggccttcaatgaggaagaagttgcaagagccatctttcactgcccggtaccggtgatctcagcggtaggacatgagacggatacgacgattgcggattatgtggcggatcttcgggctccaacgccgtctgcggcggcagagcttgcagtgtttgacgcatgcgccgtcaaagaggagaaagagaaacgcatgctgacgcttcaaagagagatggaaaggcggattcagacgatccggatgcagctttcaaaggagcaggagattttccggagacttcatccgggcgtacagattgcaggacagcgaagacggcttgcggatttggagcttcgggttcgggagaagatggagtggaaaatccaacggaaccgtcagagactggcaatgcaaatggaagtgtttgcgggactttccccgatgggaaagctcaatcagggctatgcgttcgtgacaggagaagaccaacaggcggtgcgaagcatcagcagggttcggcagggagagcatctgactctctatgtgagagatggaacgatcgatgcggtcgtggaaaggacgagaaagaaagacgatggagattaacgaaatctttgaaaagctggatgatatccaggaaaagatgcagtcagaggaaatctctctggaggattctttccggtattatgcggaagcgatggagcttttgaaacagtgtgacgagcagatcggcgccgtggaagagaaggtgcggattctggatgagaatggagaaaaacatgagtttgaataattgggaatcaagtcgagaagaaaaagtatcagagatcgaggagatattaaaaagctatctcccaaagcaggagggattccagaaggtgatcctggaggctatggagtacagtctcatggcaggggggaagcgtcttcgtccaatgctgatgctggagacttaccggatgttcggagggaagtcggatatcattcgcccttttgcggctgcccaggagatgatccatacctattccctcgtacatgacgatcttccggcgatggacaacgatgaatttagaagaggccgcaggacgactcatgtggtctatggagaggacatgggaatcctggcgggagacgctttgctgaattatgcctttgagacggctgccacggcttttgagatggagccggagtcggcgccggtcataggaaaggcgattgcgattcttgcagggaaagccggggtgtacggtatgatcggcggccaggtggtagatgtatcttcttcagggcggcagatcgagagggaaaagctggattttatttacgcactcaagaccggggcactcatcgaaagctccatgatgatcggagctgttcttgcgggggcatcgaaagatgagatccggacgatagagaggatcgcctctaaggtgggacttgcgttccagattcaggacgatattctggatgtgacaagtacgacggatgagctcggaaagccggtccacagtgatgaaaagaatgaaaagacgacctatgtgacactgagaggactggagcaggcgaagcgggacgtggaagtcatctcggaggaggctcttacacttcttgaggggcttccggtggcgaatccatttctgacaagactgctccgggaattgatacatcgaaagaaatagtgagggatttctgtggtacttgagaggatacaaaaagaaaatgatattcaaaagatagcaaaggaagatctgcccgtattggcacaggagatcagggagtttctcgtggaaaagatcagccgcaccgggggacatctggcctccaacttaggcgtggtagagctgacgatggcgatgcacctttgtttccacctgccggaggataaaatcatctgggacgtggggcaccagtcctacacccacaagattctgaccggacgtcgggaaggctttgacgagcttcgaaagtacggaggcatgagcgggtttccgaaacgtaaggagagtcagtgcgacgcattcaacaccggacacagctctacttcaatctctgcgggtcttggctatgtggaggcgcgggatatccggggggaagactaccacgtgatttcagtgatcggtgatggcgctctgaccggaggaatggcgtttgaggctctcaacaatgcatcccatctggagaagaattttatcgttgtcctcaatgacaaccagatgtccatttcccagaatgtaggcggaatgtcccggtatctggatggaatccggacggcggatgcctacacgaatctgaaaaaaggactggaaaaggccatccggaagatcccgtccggcggagaccagattttaagccatctgcgaaagacaaaaagcagtatcaaacagctttttgtgccggggatgttttttgaggacatgggcatcacttacttaggaccggtggacggccacaacctaaaagagctgatccgcgcatttcgggaggcgaagaaagtaaaagggccggtgctgcttcatgtgctgacaaagaaggggaaaggctatcttccggcggaggaggagccgtctcgtttccatgggaccgaaccttttgacatccgtagcggaaaaccattaaaaaagaaagaaaaagacagttataccgatgtgtttgccaaagtgatgtacgacatgggggaaaaggagccgtctttggttgccattacggcggccatggaggacggaaccggactggcgccgtttcacaggaaataccggaaccgtttttttgacgtggggatcgcggaggggcacgccgtgacctttgcggcgggacttgctgccggcgggctgaagccagtatttgcggtctattcgtcctttttacagcgggcctttgaccagatcatccatgatgttgcactccagaatcttccggtcgtctttgcggtggaccggggcggactggttggaagcgacggggagacccaccagggaatcttcgatctgtcctacctgtccatgattccgaatatgacggtgatggctccgaagaataaatgggagcttgcggatatgcttcgttttgctatcggatatacgggtggcccggtggctatccgctatccaagaggaacggcatacgacggttataaaatgttccggcagagggttcgttacggacaggcggagatcatttttgatgaggaagatatcgctatcataagcgtcggacatatgtttgagacagcggcgaacgttcgggaaaggctaaaagaggccggcttaaacgcaagccttgtgaatgcccggtttgtaaagccgcttgacgaggagtgcgtcgcatctcttgccaaggagcatattcttctggtgacgattgaggaaaatgtaaagagcggaggatttggagagcgggtactggattatgtgagccggatggagcttgcctgcaaagtcgtaacgattacactcccggacgattatattgaacacggcagtgtggatatgttaagaaaagaagtgatgctggatgaagaatccatttacaaaaagattcttactgtttatgcaggaatccagcatcagacagtatcagataaaggagaccagtagaacatgaaagaacgtctggatgtattgcttgtaaagcgaaatctggccgagtccagggagaaggccaaggcggtgattatgtccgggaatgtatttgtggatggacagcgggaggataaggccgggacgacatttccggaggatgtgtccatcgaggtcaaaggacatgcccttccgtacgtcagcagaggcggactgaaactggaaaaggccatgaaagagtttgacgtggagcttgcggataaggtctgtacggatgtggggtcctctaccgggggatttacggactgtatgctgcaaaatggggcgagaaaggtgttcgccattgatgtggggagaggacagcttgcctggaagcttcgtcaggatgacagggtcgtctgtatggaaaagacgaatatccgctacgtgaccccggaggatttgggagagccgatcgatttttcctccattgacgtgtctttcatctctctgaccaaggtactccttccgatttaccggtatctgacggagggcggagagatcgtggcgctgatcaaaccgcagtttgaggcaggcagggagaaggtcgggaaaaagggcgttgtacgggagaagagcacccacgaagaagtgatccataccgtgacggactacgccgcatccatcggatttacggtgaagaaactgactttttctccgatcaaaggaccggaggggaatattgaatatctcgtccatttaaagaaagcgagggaggaagcctgcgacgtgccgtctgaggaggcggtgaagggcatcgtggcagaggcctttggaacactggcaaaatagaaagatgaaacaggtttatattattacaaataacggaaaagacgaacatcataaagttacgagacaggcggcgtcctatctggaaagccggggcgtccattgtattttggacggggaggagacaaaggaaatggacgtggactgtgcggtcgtaatcggaggggatgggaccctcatccttgcggcacgggagttgctgcagcgggaggtgccgattttaggagttaatatgggtacgcttggatatctgacggaagtagaggtgcaaaatctctttccggctctcgaccagctcctggaagggagctacaccgtagaaaaccggatgatgctctctgggacagtcaaggactttcggacggatgtggccctcaatgatattgtagtgacaagaagcgaaaaccttcatatcgtacggctcaacctctatgtcaacggtgtgtatctgacgtcgtatcaggcagacggccttatcatttccacgccgacgggatccacagcttacaacctgtcggcaggcggaccgattgtggaaccgacggcgtccctgattctgattaccccgatctgttctcattccctgaataacagcagcatcgtggtttcggacgcggatctggtggaggtggagatcggatccagaaggaacaaggaagaggaggaagcgattgttacctttgacggtaccgatatcatgcggcttcgcacaggggaacgggtagtaatccagaaagcacaggaagtgacgaaattgattaaactgagcaagttgagttttgtggagacactgagggaaaaaatgaaaggaaattagccgaatgaaagtaaacagacacgcaaagattgtggaactgatccgaaaatatgacatcgagacacaggaagaattggcagaacgcttaaatgaggctggattcaaggtgacacaggcgacagtatccagggatatccgagatctgaagctgacaaaggtacctgcggagaacggcaggcaaaagtacgcccttttgcgtcacgacggcaaggagatgagtgagaagtacatccggattctgcgggatggattcgcctccatggacatggcggagaatattcttattatcaagaccgtgccggggatggccatggcggtggcagccgctatcgacgccttacagtggcacgagatcgccgggtgtattgccggggacgatacgatcatgtgtgccgtccgcagcaaagaagagacggtggacgtgatggaccgtctgcgtggaatggtcatgtaagacggtttctggcaggaaacggataaaagaaaagggaggagacatgttacaaagtctgcatgtaaaaaatctggcgctgattgaagaggcggaggtcgagtggaaggaaggactgaatattcttaccggggagaccggagcggggaaatcccttttgcttggttctgtccacctggcactgggagggaaatacagtgccgctatgctccgggagggagcagactatggactggtggagctggtcttttacgtttgtgatccacggcagcagaagaagcttgagagacttgagattgtcccggaggatggaattgtagctctgagccggaagctcatggacggcagaagtatcagtcgtatcaatggagaaatggtaccaatcgggcggctcaaagaggcagcggagattctgattgatattcatggacagcacgagcaccagtctttactgtacaagaaaaagcatctggaaatcctggacgcctatgcaaaagacgaggcagagtctgtaaaaaagcaggtacgggaagcgtgccagatctacagggaagcagtccgagtcttggaggaagcggacaaaggagaggccgagcggaaaaaagaagaagattttctctcttttgaggcagaagaaattcgggaggctgccctcattttgggagaggatgaggaactggaatcccgttataagaagatgagaaacgcaaggaagattatggaaagcctggaagaggcatacgagtgtacaggggggctttccgagacgtcagcgtcctcatcccttggccgagccatccacgccatgtccgaagtgtcatcctacgatccgaagatggaagagctctatggagaactactggagatcgaaagtcttcttggagatttcaaccgggaattgtccgatagccaggatgacttttctttttccgaggaggaattctacgaaacggaaaatcggctcaatacgatcaaccatttgaaaacaaaatatgggaactccatcggggaaattctgcattatgcagaggagaccgaaaagaagttggcggttcttcaggattatgatgcatatctggcatccttacgagagaagaaggatgtggcacaaaaggagctggaccggtggacaaacaagcttaccgaaatccgcgaaagctatgcaggaggcctctcagaagagatcaggcagggaattcttgatctcaatttcctcaacgtggaatttgatactgtgatccgccctcttccggattacaccgaatctggaagagatgaggcggaatttatgatttctctgaatccgggggaaaagaaaaaaccactcggtatggtggcgtcgggcggagaactctcccggatcatgctggcggtcaaatccgtgctggcggataaagacgaggtggaaaccctcatcttcgacgagattgacaccggaatcagcggcagaaccgcgcagaaagtgtccgaaaagatggcgcttctcgggaaacgtcatcaggtactgtgcattacccatctggcacagattgcggccatggcggacgcacactacctgatcgaaaaacagataaatgacaataagactaccacggagatccggcttctcggagaggacgagagcatccaggaactttccaggattttaggtggcgccaagatcactgaggcggttcaaagtacggcaaaagagatgaaaaaactggctgaaaacatgaaaagtaaacacctcgcagaatagaaaacagggatctgcacaaactattggggacatgttccgattgatcggaacatgtccccaaaaatcattttcagaatattctgttttaggaggcgtgatatgtgggtgaaatggtatcgaaggggcgtcctgatcgtactggtagcatttatgattctgggaggaagttattgtttcctggagtggaaacagggacagtttgaacaggaggtcagtacatcgcaggtggatgagaatctggtgatcccaggcgggatgccggtgggactttatctggagacggacggtgtgatggtgcttgggaccgaagccgtggaggatgaggatgggacgaaaaaggagccggccaaacaccttgtcaaagcgggggattacattgtaggggttgatgacaacacgattgggacaaaaaaggaactccagcaggtgataggaacaaaagaagcggaggaggtcgttctgcacctcaggcgaaacgaagagttcctggatgtaaaaacggggctgatcgacagtggggaagggaaaaaactcggcatttgggtcaaggacaatgaacaagggctagggaccgtgacgtttttggacagccagagtcactttggcgcactgggtcatgggatccgggatacggatacgaatgagcttttggagatcggggacggccgtctttacacgaccagcatccaggatatcaagaaaggtacttccggaaatcccggtggcatggaaggagtcattgtctataataattataatattttaggttccatcacccagaatacagatgagggcatttatggcacggtagaccggatcgacgccctcttttctaatcaggagccggttccggtcgctgccaaggaagagattcataccggtgacgccgtgatccgttgtgctgtgagcggtaaagtggaagagtacaagattcgtattacaaaaatcgactggaatgccagggagtcgaataagaccttggtgatcgaggtgacggatccgaaactccttgacatgaccggcggaatcgtgcagggaatgagcgggagcccgattctccaggacgggaaactgataggggctgtcacccatgtgttcgttcaggacgccaggatggggtacggtatctacatcggcaatatgttgaaccatgtcaaataagggaaaatagtggtgccatctgtcgaattgttacgacagcaaattcttgatttggcaaaatacgaaatttataatagtgatcgtagcgttttttaggaaagaatgggagaaatcggaggttgaaaggaacatggatcaagtgaatgtagcgatcgcagacgacaatgaacgaatgttggaacttttgggaaatattatttcatcggacaaggaactttcccttgtaggaaaggcgaacaatggagaagatgtgtaccgaattataaaaacaaaagaacctgatgtcgttttgctggatctgattatgccaaaagtcgatggcttaagtgtcatggatatggtaaataaggacaagacgatccagaaacggccggactttatcattgtcacagcggtcggacaggagaagatcacagaagatgcattccgtaaaggagcggcctactatattatgaaaccatttcggaacgaagtactgatcgagaaaattaaaaatacaaggtgcaaaagacatgcggagcccttcatgcaggccatggaagtacggaaacgggaagaagagaggaagcctttggagacccgcgttacagatatgatccacgagatcggcatcccggcccacatcaaagggtatcattacttacgggatgccatcattatggcggtggaggatatggacgtcttaaatgctatcacgaaaatcctctatccgactgtggccaagaaacatcagacgacggcaagtagggtggagcgtgccatccgccatgccatcgaggtggcgtggagcagagggaagcttgatgtgttagacgagctgtttggatatacggtcagcaacggaaaaggaaaaccgaccaactccgagttcatcgccctggtggcggacaccatccgattagaatataaacatcgataattctttgcaaatatcggaaaatgcggtataataagtccatagtttatgtttatattcaggaggaagacttatgaagaaaatattatttgtagcatctgagtcggttccatttatcaagacaggggggctggcagacgttgtaggttccctgccaaaatattttgacaaagaaaagtatgacgtcagagtgatgcttccaaaatatatgtgcatgaaggaagagtggaaggaaaagctgacatataagacccatttttatatggatctgaactggagagaacagtacgtcggaattttagagcttgtccatgagggcattacattctggtttattgacaatgaatactacttcaacggcttcactccttatggggacacaaagtgggatattgagaagtttgcgtttttctccaaggcgtcattaagcgccctgccgcttcttgatttccgcccggacatcattcactgccatgactggcagactgggcttgtaccggtgtaccttgataatttccggtacggcaatgagttcttccgtggcatcaaaacggtgatgacgatacataatctgaaatttcagggagtatgggatacgaagacagtaaaggatatcacaggacttccggcttactatttcgcgccggacaagctggaggcttataaggatgccaatcttttaaagggaggtatcgtctatgcggacagggtgacgacagtcagcagttcttacgctgaagagatcaagcagccgttttacggtgagcgtctggatggactaatgaatgcaagatccaactgcctgtccggtattgtaaacggcctggattacaatgagtggaatccggcgactgatccgatgatcgagcaccactacgacgcatccaacttccgtaaggaaaaggtaaagaataagctcgccctacaagaggcgcttggactcaatcaggacaagaaggtgatgatgatcggtatcgtttcccgtctgactgatcagaagggcttcgatctgattgcttatgtgatggacgatctgtgtcaggatgccgtgcagattgtggcgcttggaacgggagaagagcgttatgaaaatatgttccgccattttgcgtggaagtaccagggcaaggtttcggccaatatttactattccgagccgatctctcataagatctatgcggcatgcgacgcatttcttatgccgtcattgtttgagccgtgcggactgagtcaattaatgagcctgcgctatggcactgtgccgatcgtacgggagacaggtggtctgaaagatacggttgagccgtacaatgaatttgaaaagaaaggaaccggctttagttttgcaaactacaacgtacatgagatgcttgcagtcatccggtatgcggagaagatctactacgacaaacgccgtgactggaacaagatcgtggagcagggaatgagcagggacttctcctggaagaattccgcgaagcagtacgtggatctctacgagagtctgtaggttcagcaatacaaaagacaacttaggagtaagacatgaaaatcaaagagaaattacaatcgggaaatgtacatatatcatttgaagtatttccgccaaagacagatgacaaatacgaaagcgtggtgaaggcggtcgatgagatcgcgactgtccgcccgtcttttatcagtgtgacctatggggcaggcggtggcacaagtaagaacactgtggggatcgcctcccatattcaaaacgagcttcacgttccgagccttgcacatctgacctgcgtgtcctcgacgaaagcggaggtgcgtgaggtcgttcacaagttaaagcaggaagggattgagaatgtactggcgcttcggggcgacattccggaagggatggcataccctgcggaagataagttccaacatgcggcaggactcatcgagcttttgaaagaaagcggggatttctgcattggcggcgcctgctatccggaaggacatgtggagagcgatactcagaaggaagacatccgttatctgaaggaaaaggtggactgcggtctggattttctgacaacacagatgttttttgataaccatattttatataatttcctgtataagatccgggaggcggggattaccgttccggtgcttccaggtatcatgcctgttaccaataaaagtcagatcagacggatctgttccttatccggaacctatcttccggagcgttttaaggcggtcgtagatcgttttggggataacccgaaagcgatgaggcaggcaggagtggcctatgccacagatcaggtgatcgatctgatagccaacggtatcaataacatccatatttattctatgaataagccggaagttgcaaaggcgatcatggaaaatctatcggagattgtagatgaatagggagataagggaggccatccgttatcttggatatggaagacatgcgatagatgagcagacacttgctttggtggagtgttccatggaggagctgaaagccaaagtaagagagcgattcatctatcgcatttttgaattatcccagaaagacggagtcctccaaatcggagactggaccattgaaagtaaaggtctttcccgaaacttaaaaggctgtggccgtgtggcggcctttgcggccactctggggacggaagcggatcagatgatcaggagggcatctgttatggagatggcaaaggcagtggtcttacagtcctgtgcggcggcgcttctggaggagtactgcgacgactgccaggaagagatcgcaaaagaactatcctgcgagggctggtatctgagaccaagattcagtcctggttacggagactttgatatccggcaccaggagaagctgcttgcgcttttgcaggcggataagaagatcggcctgacgatgacaaaaagctgtatgcttacaccgaccaaatcggttacagcgttgatcggaatcagccgggagcagattccctgtcaccggcaggggtgtgaggtgtgtgaaaaggcagattgtctttatcggagagcataaaagtcaggaacggataaggagtgaaaagatgagagaacggcttggaaaagagttattgtttttagacggcgggatgggaacccttctgcaggagcggggactgcagccgggagagcttccggagacatggaatatccgaaagcctggggagatcacagagatacacagacagtattatgaagcgggaagcgacattgtgcttgccaataccttcggcgctaatgcacagaaatttcacgatgacacctggccgctgaaagacgtgatcttcgcagcagtggaaaacgccaagaaagccagaattctggcgggaaaagacgacggcagacattacgtggcgcttgatatgggaccgaccggaaagcttctggagccgatgggagacttgtcatttgacgcagcctgcgaggcgtttgccgaggccgcgagactgggagccgaggccggcgccgatctgatccatattgagacgatgagtgatacttatgaatgtaaggcagccgttctggcggcaaaggagcagacagatcttccggtctttgcgacattgattttcgatgagaaaggcaaactgcttaccggtggagacgtgttaagtaccgtagctctgctggagggcctgggtgtggacgctcttggtatcaactgtggtctggggccgcggcagatgctcccgattctaaaggagatctgcaggcatgcgagtattccggtaattgtgaagccaaatgccggactgccaaagcagcggggccaggaaacttactatgatgtgacaccggaactgttcgccggatggatgcaggagatcgtaaaggccggggcttgtatcgtgggcggctgttgtggtacgacgccggagcatatccgcaggatgacggatatctgcaaaaatatggccgtacagaagcagaccgagaaggaggagacggtggtttcttcttatggacaggccgtgattttgggtgactgtccggtgatcattggagagcggatcaatccgaccggaaagaaacggtttaaacaggcactaaaagagcatgatattgattatattttaaaagaaggaatccggcagcaggaacaaggcgcgcatattttggatgtgaatgtaggccttccggatattgacgagccatccatgatggaagaagtcgtaagagaactgcagggaattaccagtctcccacttcagattgatacggtggatcaggaggcgatggaacgagctatgcgggtttacaacggaaagcccatggtcaattctgtcagcggcaagcaggagtccatggatatggtctttccgctcgtacaaaaatacggcggcgttgtgatcggacttgcgctggatgaacaaggaatcccggacacagccgaggggcgggtggagattgccggaaagattatccgggaggcagcgaaatatggaatccggccccaaaatattgtcatcgatgtgctgacgatgacgatcagttcggaacccgagggagccattaccgtactgaacgccctggagatggtacgaaataaatatcacgtccgtacagtccttggcgtgtctaatatctcattcggacttccataccggccggcagtgaactcgatattttatgcccttgccatgcaaaaggggctgactgccggaattatcaatcctggatctgaggagatgatgaaggcataccgctcgtatctggcgttgatgaattttgacccgaactgcgagggctatattgcggcttatgcaggctatacccagccggaaggtgtccgtgccgtagggacccagccggtttccgggggaagtgtgggggagatgaccttgcaatacgccatcgagcgggggctaaaagaggaggcgtcccgactgacaaaagatcgagtggcagtagaagatccgcttgctatcattaatgaggatctgattccggcactcgacatcgtagggaaacgcttcgaaaaaggaacgctgttcctgcctcagcttctgatgagtgcggatgccgccaaggaagcttttgcggtgctgaaagagacgatggatcgaagcggcgttgtgcaggataagaaagggaagatcatccttgccacagtcaagggagatattcacgacattgggaagaatatcgtcaaagtactgttggaaaattatggatttgacgtgattgatcttggaaaggatgtggaaccggaacgaatcgtcgagacagcaaagagcgagcaggtccggctggtgggattaagcgccctgatgacgacaacggtcgttaacatggaagagacgatccgattgcttcgcaaagagaagccggactgccaggtgatggtgggcggagccgtcttaaatcaggaatatgccgatatgatcggagcggatttctacggaaaggacgctatgcagtccgtttactttgctcagcgactgcttgacacacccggcacgatccattatgataaataagatagacaaaaagagaagattgaaagatacaatgaggaggcattcaaagtcatgcagacttatggggtaaatgaattaagaaagatgtttcttgatttttttgagagtaaagagcatcttattcacaaaagttattcactggtgccacacaatgataagagtttactgctcatcaattccggtatggcgccgctgaaaccgtattttaccggacaggagattccgccaaagcgtcggatggcgacctgccagaagtgtatccgtaccggtgatatcgaaaatgtaggaaaaaccgcaagacacggcaccttttttgagatgctgggcaacttttcttttggtgattattttaaaagagaggccatccactggtcctgggagtttttaactgaggtggtgggtcttgatccgaatcgtctgtatccgtccgtatatgtagatgatgacgaggcgtttgagatctggaacaaagagattgggattccggccaagcggatcttcaagtttggaaaagaggataatttctgggagcacggttccggaccatgcgggccatgttctgagatttactatgaccgtggcgagaagtacggctgcggcaggccagactgtactgtaggttgcgagtgtgaccgttacatggaagtctggaacaatgtcttcacccagtttgataatgacggccacggcaattacagtgagttggagcagaagaatatcgataccggaatgggactggagcgtcttgcttctgctgtacaggacgtggattccatctttgatatcgatacgatgaaagcgctccgtgaccacgtgtgccgtctggcaggtgtaatctataagaaagatgaaaaatcggatatttccatccgcgtcatcacagaccatatccgttccgtgacctttatgatttccgacgggattatgccgtctaatgagggaagaggttatgtgctgcgccgtttgctgcggcgtgcctgccgccatggaaggattcttggcatcgacgggaagttcttatccggattgtgcgagaccgtgattgggggatcaaaagacggttatccggagttggaagagaaacgtgattttatcctcaatgtcatcagcaaagaggaagaccagtttaataagaccatcgaccagggacttggtatccttgcggagatggaaggtgaaatgaaagaaaagggcgagaccgtattgtccggcgatcatgcgttcaagctctatgatacctacggatttccgcttgatctgacaaaggagattctggaggagaaaggcatctctgtagatgaagagggattccagaaagcgatgcaggtacagcgtgagacggcccgtgcggcaaggggagtgaccaactatatgggagcagatgtgactgtgtacgagtccatcgatccgtctgtgacctccatctttgtgggctatgagacactgatccacacgtcaaaagtgacagtgctgacaacagagagcgaaattaccgatgcactgaccgaaggggtagagggaacgatctttgtcgaggagacgccattctatgccacaagcggcggacagaatgcggaccatggcgtgattacgtctgaggatggaagctttgtcttccaggtaaaagatgtgaaaaaacttctcggcggtaagattgctcatatcggaacaacagtaaaaggcatggtccgtaccggggaaaacgtggttctgaaagtagacgaggaaaaccgccgcctttccggaagaaaccatagtgcgacccacctgcttcagaaagcgctgcgtaccgtacttggcacccacgtagagcaggcaggttcttatgtggacgccgcaagactgcgctttgatttcacccatttctccgcgctgacaccggaggaaatcaaagaggtggaagagattgtcaaccgagcaattgctgacgcccttccggtgaaagtggagaatcttccgattgaagaggcgaagaagaccggagcacaggcactgtttggagagaagtacggggatattgtacgggtagtcagcatgggagaattttccaaggaattctgtggcggaacccatgtggacaataccgcgtccatcggctcctttaagatcatctctgagtccggtgtggcagcaggcgtgcggagaattgaggctctgacatcccagggtctgatgaactattacgcaaatctggagcagatcctccatgagacggcaaaggcacttaagacgacgccggagcacctcgaagagaaaatcggacatcttcagtctgagaacaaggagcttagaagcgaggtagagagcttaaagagcaagcttgccaaggatgcgatgggagatgtgacagaccaggcagaagtgcttgacgggatctccgtgatcaccgcaaaggtcgaaggtgtggatatgaacggattgcgtgatctgggtgaccagctcaaagagaaagtgggagagggcgtgattgtgattgcgtctgtagcggacggtaaagtcagcctgatggcaaccgcgacggatggcgcagtgaagaaaggtgcccatgcaggcaatctcattaaggctatcgcaggactggttggcgggggcggcggtggacgcccgaacatggctcaggctggcggaaagaatccggacggcgtggacgcggcactggcaaaggcaaaagagaccgcaaaagagcaactggcgtagtgtctttggcactgatttttccggaaagctatgaaaaataccttgacggataaggaaattatggtataatacttgtagtgcaataaaatacccgaacagtcgtatgatgcacaatacaggactggaggggaggttaggtgtgagattatgtcaaatgtaatcgttaaagaaaacgaaagtttagacagcgctttacgcagatttaaacgtaactgcgccaaagctggtatccagcaggagattcgtaagagagaacattacgaaaaaccaagcgtaagacgtaaaaagaaatctgaggctgccagaaaacgtaaatataactaagatgtgcagaaacaggatgccgaccggcatcctgttttttctatcacacaggaatacctttgacacatggaaacctatgaaaagtaagaatgagacaggagaaatatatgagtacaattctaattgtagaagatgatgtcaatattaatgagatgctgaaagtagcgcttcagaaggagggatattcttgcatccaggcgttttcagggacagagggcagacttgtcttatctcaggaggagccggatttggtgcttttggacttgatgcttccggggatgtcaggggagacgcttctggaggagatccggcagacaaagcgggcggtaccggtcattgtcctgtcggccagagatgagatggattctaaggttgacatgcttcttagcggcgcggatgattatgtggtaaagccgtttgaaatccgggaagtgctggcaagagtccaggttcagcttcggaaacgcaccggacaggaagagaaaaaggttctggaacataatggcttgcttctggatacggaggagcaccagatctatgtggacggcgtgaggctggaagggattacgaggcaggaatttctcatcttacagctctttcttcgctggccgaaaaaagtattcagcaaggaagagatttttgaggcggcatgggaagagccgtttatgggtgagacgaaggcaatcgacgtccatattagtaatattcgtaagaaaatgaaggcaatttctgagaggtcttttatcgatacggtttgggggatcggatatacactttccagatgatatctttacgaagtctttactttttatttgcgaaggattagagaagaaggtgtaggataaaagcaaataaaaaaaggagatgatacagtgagtcagatgatagtaaaaacccaggaactgacaaaacagtacggtcatcatagagcggtcagttcgatcagtatgcgagttcgaaagggggccgtatacggactgatcggaaggaacggagccggaaaaacaactttcttaaaaatgctggcagggcttgccgctcctacgaaaggagagattgagttgttcggccggaaaggcagggagcttggagctgtccgatccaggatcggatgtctgatcgaggccccgggaatctatggaaacatgaccgcatacgataatctggatctgaaatgccgtttttttggaatccgcaagaaaggatacatcgaagatattttgaaactaatcggattgtcagattcgggaaagaaaaagacaaaaaatttttcccttggaatgaagcagagacttggcattgggctggctcttgtgggagaacctgatcttttgcttcttgacgagcctatcaatgggctggatccgcagggaattgtggaggtcagggataccattatgaggctgaatcaggagcgtaatatgacgattgtgatttccagccatatcttggaggagctttccaagattgcgactgattacggaatcatccatcacggagagctgatccaggagatcacaagagaagaattgatgaagcgctgtgtagaacgtctggagattgctacggatacaccggagatggtggtgcctgtgctggatacgatgggaatcaagcggtatcagatcgtggattccggtcatgtctggatctttgacggcattgatcaaagcccgacgatcaatcgcgagcttgtccaggcggggattgccgtcaaagaattgaaactctgcagcgaaaaactggaaaattattacttaaatctgacaggaggtggcagtcatgctgaatatcattagaatggatttcgcaagaatgatgagatccaaaagccagtatatcctttggattgtgatggcggggctgttgattttaactaccgccacgatggggtcggaattccgggatcccaaggccagcgccgagaactgggcgacgatccaggatcaggcgggagaatctgcggaaaacctgggaatgtatgtaacaattccgaccaaaccgggtgagaaggcaacgctttatgacctgttctatgggaatgtccaaggcaaggtggaggccatttttgtggtgatctttgccgtactctttgctacatcggatatccgctgcggttatatcaaaaatataggaggacagtgcaaaagaagaagttcccttgtactttccaaggcagtgaatctgttgatttacacggtactgacctttgtaattgccctccttgtgcaggtcgtctccaatcagattttcttcggctatctggagatcggtccggtgtcggaactgtcagcgtatgtcgcggttcagatactgcttcattatgcgctggctctcattgtgatggcaatcgcaattatgatttccaacaacctgatcagtatgacgtttgcgattttgatgtgtatgaatatgacgatgcttctttacgcaatgatcgagaaaggaatccattccctgtttgataaaaacgtggatttggttactcataccgtgacgggatcgatcagctttttacaggctcacgggagctcggatgcattgtttaaagcctcgctggtggcggtaatttacggtgtggtttttaccacagtcagtgcgcttgtgtttcagagaagggatatcagataaatggaatggatcataggaattctggcagcatttcttattctactattattaaaactggttggcattttgcggcagatacgggatatctgccgccagttgacgtttctgaaagactacgacagtaatctgatgattaccgggcaggaggcttccgggcctttgagggaattgatggacgagctcaatgagatgttggaccgtcaacgagaacaaagaagacggtatctgaaaaaagagcaggatatttcagacgcctacacgaatctatcccacgatatccgtacgccgctcacctccttaaacggctatttccggctattggaggaaagcgaggatccgaaggaacgagcgagatatttaagtgtcattgaggagcggatcaacagcctcaaggagatgctggaggaactctttacatataccaagctgaaaaatgagacgtatgtgctcgagatggagccgctttatctgaaccggattgtgacagaaaccgttttctcttactatgatgtctggatggagaaaggaatcgagccggagattgacttttcagaggaacagatgaaaatagaaggcaatgctgccggccttcgcagaactttacaaaatatcatcaagaatggaatggatcacggtacagggaagatgaggatcaccctgaaacggcaggatcagtgggcggtagtagagtgtatcaactatgtggagcacccggaggagattgaggtagagaaggtctttgagcggttttataaagctgacgaggccagaagcagaacatcgtccggtcttgggttatctatcgcaaaagctttcaccgggtatatgaatggggaaatccgggcgcttcttcagggaaattggttttccatctgcctgcgctttccgattctttcctgacagggacaggcatattttgggatgggagatcttacaatataataaatgccaggtgaagaggtaagatgtgaaaaagtggattacggtgttgatgacggcagtgatgctggctctgaccgggagctttgccgtcatggcagaagatgagacagaaggagaaaacggaggaacagtgaccgttacagccccttctgttcttttgatggaggcgtcctctggaaaagtgctttttgaaaaagatgcggatacaaagcgtcctccggcaagtgtgacgaaagtaatgacaattcttctgatttatgatgccctttctgaggggaaaatccataaagaggatgtggtgacggtatcggaatacgcggcgtctatgggcggaagccaggtgtttctggaggctggggaagagcagacggtagatacacttctaaaatgcatcatcgtgtccagcgccaatgacgcttgcgtggccatggcagagctgattgccggaacagaggaagcctttgtccagcagatgaatgagcgtgccaaaggtcttggtatgaaaaatacagtctttaaaaactgtaatggactggacgcagatggtcatgtgacaacggccagggatattgccctgatgtccagagaattgattaccaaatatcccgatgtatatgagtatacgaagatctggatggacactattatacataaaacaaaaaaaggcgagtcggaattcggcctttccaacaccaataagctgatccggcagtattcctatgcgaccggactgaaaaccggctctaccggagaagcaaaattttgtttaagcgccacggctcagaaagatgggattgatctgattgccgttatcatggccgcgcctgatgtgaaagcccgatttgcagacgcacagacgctgttaaactatggattttccgtgtgcagaaagtacgaggatcgtgactgggaatccttgaaaaaggccgtgaaggtaaaacgtggggagaccgatcaggtggaggcagtgcaggaacagggattttcctacgttgatgtcagcggcacggatctaagcgggattgaaaagaaagtactgcctgacaattcgctggaagctccggtaaagaaagggcagaaagccggaaaggttcagtatcttctgggaggaaagacgattggagaagtggatcttgtgacgacagaagaagtacctgcgatgtctttgaaaaaagcgatcgaagatgttttagacagcttttcattgtaaaagggaaagaaaaattatataatgtctaggaaaaggagctggaatcatgttaaaagagaagaaatattttttatttgacattgacggaacgctctctgtcgggacgacattatatgacgggacaaaagaattcctggattggatcgaagaaaccggcggacggtgtttttatattacaaataattctacaaaaagcagaaaagattatgtggaaaaatttgcggcgtggggcattaccacagaagaggcacagtttatgaccgcatcgtatgccgcctgtttatatatgaaagaacattatgaagggaagaaggtgttcgtattgggaacgccttcttttctggaggagcttcgaagccataacgtgcaggtgacagaagaggcggaggatgatgttgtttgcgtcctcgccgggtttgacgatacacttcgatatgaaaagctcataaaggcgtgcgaactattgttccgagagggaatagattttctggggacgaacccggatctgaggtgtccggcaccctttgggtttatcccggattgtggcgctatctgtagaatgatccaggatacgaccgggaagaggccatactttatcggtaaaccaaaccgggtgatcgtggatctctgcgccagccagtgcaaaggtacgccggaggaattccttgtcgtaggagacaggctgtatactgatattgcctgcggcatcaacgctggctttgagacagcggtcgtttacaccggagaggcggacgaagaggaggtgcggacaagcatctggaaaccggactactgctttgacacgatccgggatctctatgaagccgttcggacggagatggaggaagggagaagatgatcgggcttttgcttatttttctgctcattgtggtacttttgagctttcggattttttatgagaatcatacttttgtcatgcggtactatgaagtggaaaaaaagatgggaagtcaggatgagggaggctggaaaatcgtatttttaagtgaccttcacaataaagaatacggatctggcaaccaaaggcttctgggcgcgatccgaagagaagcgccggatctgattttggtaggcggggatatgctcatccgtagtaccggggagaagtccgaacacgcagccgcgtttctggagaggcttcctgccattgctccggtatactgtgccaatggaaaccacgagcagaagatgaaagagtgtgaggaaacttacggagaggcttaccgaaagtatcgcaaaagactggcagattccggaattcatatgttggaaaacgaagctgatacgatttggattcggggccagcggatgcagatcggcggattggagattccggtgtcctttttcaccaaacagtttccctggaaacaccatgaaacatatcgggaggagagtccggagaaacagatgccgggacagtttgatcttcggccggtttcagagggaggcccgtacaaaatcctgctggctcatcaggcactttatgcggaaacgtacgcaggatgggggatggatcttgtattatgcgggcatcttcacggaggcgtcgtgcggcttccggggattggcggcgtgatctctccacagcttactctgtttcctaaatattccggggagcactcccgttttagggactgtgacatcattgtcagtaaagggctaggtggacatagtattccaatccgcctttttaaccgggcggaagtcatcgtcattcgccaaaagtcttgagaaagacgggcggatcaggtataataaaacggttacaagacgcaaagagaaagaggaaatccaatgggtataccggtaaagcttccggtgttcgaggggcctctcgagctgctcctacacctgattgaaaaaaataaaattgatatttatgatattccgattgtagagattacaaaccagtacatggagtatatccgtcagatggaaagggaggacctcaatattatgagcgagttccttgtgatggcggcaacgctcctggacatcaagtgccggatgctccttccgaaagaggtcaacgaggaaggagaggaggaagatccgaggcaggagcttgtcgagcagttgttgcagtacaagatgtacaaatatatatcctatgagctgcgggaccgggaagtgctgggaggacagaggttctaccgggacgctccgcttccgaaagaggttgcacaatattcccagccggtggatttggatgagctgataggagatctgacacttaccaggcttcatgaaattttccgggaagtcatacgccgtcagcatgacaagattgacccggtgagaagccggttcgggaagatcgagaaagaagaggtgacgctaccggaaaagatggagtttcttgcggagtatacacggactcaccgctcttttcggttccgggatctcctgatgcggcagacatccaaagtacaggtgattgtgacattccttgcggtgctggagatgatgaaagcagggaagattacggtcagacaggaggacaccttcggggaaattatgattctatccaaagacaaggaggacaaagacggtggagatacggaaactagaggggatcattgaggcgatactctttactatgggcggaagcgtggagcttggccggcttgccggggcactggaagaaccgcaggagcgtatccgtgaggcgattgccgccatgcaggaacgatatcgggcagaagacaggggcatcaatatcgtagagctggagggagcgtatcagatgtgtacgaaaccggaggcttatgactatctgattcgaatcgcaaagcagccgaaaaagcaggtgcttactgatgttttgctggagactttgtccatcatcgcgtataagcagccagttacaaagattgagatcgaaaagatccggggagtgaaatccgaccatgcggtcaataagcttgtggagtataatcttgcctgtgaagtaggaagattggacgcgccggggagaccgcttttatttggaacgacagaagagtttttacgaagattcagtgtccagaaattggaggatcttccgggaatcggcccggaacagatggaatcctttaaagaagaggcggaagacgaagcaaagatccagttgcatgtgtaacagtaaaatgatggcaaacagcgggctggacagggaaaagaaaggacagacattatggcaatgaaaatacaaaccagacttccggagccggaagatctgaaacaggaatatccgatgacacgagaaatgaaagagaaaaaaacggtacgggacggtgagatccaaaatgttttcactggatattcggacaagtttctcgtcattgtgggcccgtgttccgcggacaatgaggactctgtctgcgaatacgtggaacggcttgccagactgaatgaggaagtaaaagacaagctgattttgatccctcggatttatacgaataagccaagaaccacaggagagggctacaaagggatgctgcaccagccaaaaccagatcaggcgcccaaccttttggagggactgattgcgattcggaaacttcatctgcatgcgattgcagtcagcggactgaccggggcggatgagatgctttacccggaaaatcgaagctacttggacgacattctttcttacgaggcggtcggggcgcggtctgtggagaatcagcagcaccgtctgacagcaagcggtatggatatcccggtgggaatgaaaaatccgaccagcggcgatctttcggtgatgctgaattcgatcaaggcagctcagggggctcatcagttcatctaccggacgctggacgtcacgacaaacggaaattcgctggcacacgccatcctccggggaggcgtggacaaatacggaacctgtattccaaactaccattatgaggatctctaccgtttaagcgccatgtaccagacgtccggattgaaaaatccggcagttgtggtggacgccaaccattccaactccaataaacagtacaaagaacagattcggatcgtcagcgaagtgatgcacagcagaaattataatggggatctgaaacaacttatcaaaggagtcatggtggagagctacctcatcgagggacggcaggaaatcaccggaaaccggacttatggccagtctataactgatccatgcatcggatgggaagatacggaatacctgatcagaaagatagcggaggaatgttaatcttacgaactggtttgggaaaataaacttaacctatcataaaaagaaggatcattaagaaagtgacacaagggtcaaaggaatgaaaatatgaagacggacaatatctgggctccgatctgtgggcatgcgatctataatgcgatgtcggcaagtgtactccctatcgaagcagtggtcaatatgggaaagacaggagcgatcatgtatacacttttaacggtagtgtgctgctctctttttgccttaaaaaaggaatacagaaaaaatttgtaaggtacaggtaaaacaaagggagcggaaaatcaagacaaatctgtgatttcagtccggatcagggtgtttttggcataaagattttcaaaagttcataaagttgtcttagatagtctggacgggagtggtcaacaggatatggcaaatggcggatatcggaaaataatcatactatgcatcattgttgtgtttggggtgtccgtaaggatgacggagacgctattatgtgtaaaggcggcggataaaaaaacaccggatgatttaaagctctatgcgcagtcagcggttttgatggatggagagagcggaagggtgctgtttgcgaaaaacggagaagtagagcggccgatggccagtacaacaaagattatgacctgtatacttgccctggagttgggaaaagggacagatgttgtcacagtttcaaaaaaagcagcagcccagccggaggtgcatctggggatgcgggagggggacacgttttatctggaggatcttctatattccattatgctggaatcgcacaacgacagcgcctgggcgatagccgagcatattgccggatcagtggaaaactttacagatttgatggacaaaaaagcaaaggacctgggatgcggccataccaattttgtgacgcctaatggtctggatggagaggatgcagatggtattcaccatactacagcggaggatcttgcaagaattatgaaatactgcattatggaatcaccgcagaaagatgcttttttgcagattacacagacaaagtctaaaacatttcaagatactacagggaagaaacagtatgtatgtaataaccacaatgcgtttttaagtatgatggagggagcactgaccggaaaaacgggttttacaggagaggcaggatattgctatgttggtgcggtacgacagggggaccggacattgattgtcgcactgttggcatgtggctggccgaacaataaaaactataagtgggccgatacgaaaacactggtacagtacggcttagatcagtacgggtactgtaattactgggaggatgccatgcaggatcaggatattcggatactggaagcaggaaagaaaaggaccgtaaaagatgcccccgctaaagatggaaacctttatcaggacgggacagtaaatacatttttaaatattgacgaccaggatcgggaaaaaagaatcctaatgaaaaaaacagaggccattcaggtacagattgaggaaaaacaagagattacagcacccatagagagcggagatatactcggaacagtgacaattttactgaacggagagacactcgatgaaaagccgattgtcagtggagaaagcatccaaaagaaaaatctgctctggatttacaggcagctttggaagagctatgcactttgagctttcgtttttaaaacttgggggacgtgtttcgctgcattggaacacgtcccccaaaatcaatccttaaatctctcttgtatatgtcttgagccattcccgctcttcatctgtcagatgtggagcgattttttcatatacttgtttgtggtagtcattgagccagtccttttctgctttggacaggtactgcggatcgataccatcgagatcgattggggcgaaggtaatcgtctcaaaatacatgaactggccatatttgtttgcggttccttttctgacgatgaattcgttttcagtacggataccgaatttgccatcttcataaatacctggttcgtctgtgatgaccataccttcttcgagctgatgatgctcattcttgctcgggacgatataccagcggaagcctgtcggtggttcatggacatttgcgaggtatcctacaccatgtccggttccgcactggaagtcaaggtctaattcccagattggctctcttgccagaacatccagattgtatccatagcagccatagaggaatttggcgcgtgccaggttcatcatggcgcggacaacggctgtgaagtacttcttcagttcctcgttgatagacccaagtacaaaagtacgggtgatatccgtagatccttcgtagtaaccgccgccagtatcgttgaggaagaggtttccttctttgagctgtacatccgtctccttggaaggagagtagtgcatcatggcagcatgatccgcaaaagcgcaaaggggctcgaagctgtcgcggatatacccttcttgttccgcacggaggcttgtgagtttgtcagcagcgctaagctctgtgatgacctctttatcgtatctggttttgatccagtacatgaatttcgtgatggctacgccatccttgatgtgagcctctttaatattttccagctctacaggatttttcattgctttcataagaatcgtcggatttgcacattctacggtcttacaaggaatattcttataaagcgcataattcattttcatcggatcgatcatggcaacatcattttcggaaagatttttgatatcttcataaatatcattgtacggatgcagaacaacatcgacttttgcaaattccgcaaggatttggtcgttcagcttggtttcatccacataaagatctacgctgtctgtctttacaatcgcgtaggagagcaggagcgggaagaaatcgatgtcatcgccgcgcacattgagcagccagcagacgtcatccaaagaagcaatgatatgtacggttgcaccctgttcttccatgaccttccgtactctttttagtttggatgaagcgctttctccactgtacttttcttccaggaaaaatgccggtttgtcagaaagtggcgggcggtcttcccagatctgatcaatgagatcttctgagtaatcgatttgaataccttttttcgtaagtgcttcctcgtattcctgtccttcgcccatggagaggacacgtccgtcgaatccgaccttaccgcctttcgggacgtaggatgcaagccattcagtgacagacggggtatctccgacaaacattttcatcagtctgacgccgcttccttccatttcatgctctgcctggaagaaatatcttccatctgtccaaaggccggcatcatcttttccgatgacagcggttccgtaagatccgctgaaccctgtaataaattttcttgctttaaaatgttcgcctacgtattcgctctggtgaaaatcagcggtcggaacgacataggcgtcaattcctttttcggccatcagagcacgaagtctggcaattctgtctgctacaacagtcatgagaaaaacctcctttttctaaaataaatttagctatccatattttatcactatttagaccggagttcaaatcttatgtgtgggaagtgtgaaaaacttaaaaattgtataaaaaaagcggtatggaattaccataccgctttctggaaatcattcctatttttcatctgcaagtttgtcaagtttaccactgaatgcatacagtagaaccgcacagacaataaccactgcagcaatgatgccgtagtagagattgaattttccagctcttgaaccagcatccaatgcaccgtacagactcgggtaaatcagtgtagcaataaatacagcgattggccagaatcctaacagaagacccatcagtttcgcaggtgcgaacatggaaataaaggagtttccaagtggtgagaaaatcatttctccaacggacattaatagtgcgatcaggattacccagaaccaagagcactgtccgtcgccacggattatattagctaataccatagctacgtaggaaagacctacaaggaaaataccaatagctgtcttcttgaacatggacatgtcacccttcggtcttgcagccatcttagcccaaacgatggcaaaaacaggtccgagaacgatacatgtcagagcattcagagagtcaaagtaggatgtctgaggaatcttccatccgaacaggctccagtctgcccagttcaggaattcggagctgtcaccgaatccgaagtagtagtaaactacgttgtaggacatataccaagcgatccagaagattgcagaaagaagagtaacaataatgatagcgaatacacgcttcttgtcgcctgttgtaagcggtttgctctcttccgcagctttcttgtctttgtcaacgaaagatctctggtctttcttgaacggctctttacccttgttaccaagagctttaccgtttgcaaggaaccaaacagcgtctaccagaaggagaataccagcgatcagaagcaggaactgatatccctgagaatccgcaagcagtacgacgaatgtcgttccgatgaaagaaccgatattaacgaaagaatactgtacggagaacgcggagttcagttcatcctgatcatcaaacatcaaactgttgacaccggataagttacctttgaataaacctgtaccaacggcaacgaggataatcattacccataccagtgttaagtttgttgcctgccatccgacaagatagccggcacccataagaatcataccaagaactacgcaaagtctcgggcttacccagtagtcagcgaggtatccgccgatcatcggggtaatgtaagtagctgctacgaagtaagcggagatttttcctgcttcaacagaagtaagtcccataccacccatcttacttgttgtctctgtagcaagccaaatggcaaggagccattttacagtgtagaatgcacatctttcaaatgtgaatcccagagaacaagcgtagaaaccaaaaggataacctttcttggatttagttgctgtgtttcccatagtcaaaaccctccaataaattttttgatttctcatacgtaaatcatccaggccttttcctaagatttaaggaaaaaactctacatgcaaacgcacgaagagatgtctgaattgaaaacagacatggactgatgcagcagcttatgtcagaatcggatcagacggtagtctgccttacggcggatgtctttttacagattatgaaatcagcatccataatataccggctggaaaaagactatgtaaaggaatgatagttcgcagaagaacaacatcaaaagacagagtgaacagtctaaaaggctgtcagggaatgatctgtctccttgtctttgcccggtcagaataatcggacaaactggcaggacggaagaggaaaactcccttttctcatccagctaccgaaccggcccgaactttttcacagaatcgaaaagatctgctcttggcagaagatgccgtgaaaaagatccggtctgctccgcatctggataatatccgcgatctgacagatccaggtactgcattagcccagctctgtaagatccatccacctggacggtggaaaagcgatgcgagacaaaaaattgtcccggctgaacatcagatctgccattacctcctgacctgggagaaagccaggacagatctgctttttgactcggaatcacttttgattgccataaaaagacaaaagatgtcatctcttctggaattcctttataacataatgacatccctgtatgaagtattttaacacaatttgactgtcgagacaatgaattttttgtaacacgccttaaaattattaaatttttataaaaaaatgacagaaaaaaggaaaaagaaaataatgaattggataaaataaaaaagaggtaaaaaatatacagaaaaaacatgagcactttaaaatgataatgtactacattgctgaaaaaaactgtcaaaaatttcacacaagcacttgaaaaatgaagctgtagaacctataatataattggctaaaatttggtttaacttttagtaatataatacaaatggagggctaggtttatgagtaacgaagcagcaaaaacgccggcagctttcaggatttcagaattactggatgccggcagctttgttgaaatcggcggcgccgtgatggcgagaagtacggatttcaacatgcaggaaagcaaagttccgggcgatggggtgatcaccggatatggagtcattgacggaagtctggtatacgtctacagccaggacgcatccgttttcggcggctccattggagagatgcacgcaagaaagatcattgcactttatgacatggccatgaagatgggagcgccggtgataggattgattgattgttcgggactgcgccttcaggaaggcacggacgctttacaggcgtttggtacgatctatgcgaaacaggcgctcgcatctggtgtgattccgcagatcacagccgttttcggaacctgtggcggcggtgcggcaatcctttccggtctttctgattttacttttatggaagaaaaaggaaagctttttgtcaattctcctaacgcgattccggggaatcgtgtggaaatatgtgatacttccggcgcgaggtttcaggctgaggaagcaggaaatgtagatttttgtggaaccgagggagagattctctcacagatccgggacctgatctgcataattccagcgaataacgaagataacgattcttacggggaatgtacagatgatctgaatcgcgtgtgcgccggaattgaaaacggttccgatgatgctgctctcgttttgtccatgattgctgacaatcagaaattgatagaagtcaaggcggactatgcaaaagagatggtgaccggatttatccgtatgaacggtgtgacggtcggagttgtggcgaaccgttcgaaagtctacgatgaagaaggaaagacacagcaggaatttgacggttccctgtcctccaaaggatgtaagaaagcagcggatttcgtgacattttgtgatgcctttgagattccagtattgacgctgacagacgtagatggattcaaggcgtccaagtgcggcgagaagacgcttgcaagagaggccgcaaggcttgtttatgcgttcgcttccgcaacagtgccgaagattaatgtggtgacaggaaaggcatacggaagcggctaccttgtgatgaacagcaaggcgctgggcgcggacatggtttatgcttggaccgatgcccggattggcacgatggatgcgtctttggctgcgaagatcctctgtccggatgcatctttagaagagcaaagagcgcaggcggaagtttaccagaatcttcaggagagcgcggcttccgcggcggcaagaggctatgtggataccgtgatcgctccggaagatacaaggaaatatgtcattggagcgctggagatgctctttacaaaaagagaggatcatccggtgaaaaagcacggaacaatatagagaggtgagacgagttgaagaagagaataagtttattggcagtcctccttgctctcgtgtttgtcctttccggatgcagcgaaagttctgaggcggactacgacaaagagacgctgatcagtcaggcggacgcactcatctccagtttcagtcagatgtcgtccgaggagctggacgctttcaaagatgtgaacgaattgcagctgaatctgacactgcttcagtccggatttaatgtagatgcggccaactttacaacgatgattgatgcctgggaagcaggagtcgaggagtgcggcgactatgtagagcatgatgattttaaagtagaagagagttccggcagcatcatgctgacatcagatgcaaaatacaaggacagagacgccgagattacaattgaatttagcgaagattccaagatgttgagctttacagcctcagccaagtatacgatgggagagattctgaaaaaggcgggattgaataccgtacttggaatgggaacggtatttgtcgtactgattttcatttcctttattatttccctgtttggtctgatcggaaagacacagcggaaaaaaacggaaccaaaacaggcggaagtcttgaaccatccggagccggaagaaacagaagcttcagaagagacggcagaagatctgacagacgatctggaactggcagcggtgattaccgcggcaatcgcggcaagtgaaggcacttctacagacggatttgtagtgcgttccattaaaaaaagaagaaaaaacagtcagtggaaataggaggaagcaaatatgaaaagctatacaatcacagtaaatggaaatgtatatgacgttacggtagaagaaaacggcgaggcagttaaggctccggcggctccgaaagccgcgccgaaggcccctgcagcaccgaaagccgcaccgaaaaacgctcagggagcaggaaatatacgtgttgaggcaggagcagccggaaaggtatttaaaatcgaggcctctgtggggcagaaggtcaaaaggggagacgcagttgtcatcattgaggcgatgaagatggagatcccggttgtcgcaccggaagacggtacagtggcgagcattgaattggcggtaggagatgcatgtgaagccggaaccttgcttgcaacattaaattaatgacaactgacaatggaggttagaacatgagctatataatagagacgttagggcgtcttgtagagcagacggcatttctgaacctgacggttggcaacctgattatgattgcggtggcatgtgttttcctgtaccttgcgattaacagagggtttgaaccgcttcttctcgttccgattgcttttgggatgcttcttgtaaatatctatccggacattatgttgtcttttgaggacgcagaaaacggtaccggtggacttttgtattatttctataaactggacgaatggtcgattcttccgtccctgatcttcatgggcgttggagcaatgacagatttccgcccgctgattgccaacccgaagagttttcttttgggtgcggctgctcagtttggtatctttgcggcgtacctgggagcgatggcaatgggattctctgacaaggcggcagcggcgatcgctatcattggaggcgcggacggcccgacttccattttcctctgtggaaagcttcagcagaccgcattgcttggcccgattgcagtagcagcgtactcctacatggcgctggtaccgatcattcagccgccgattatgaagcttctgacaacggaaaaagagagaaagatcaagatggaacagctcagaccggtatccaagctggaggcgattctcttcccgattatcgttaccatcgttgtctgcctcattcttccaacaacagcaccacttgtcggtatgctgatgcttggtaatctcttccgggaatccggagtggtaagacagcttacagagacagcttctaacgccctgatgtacatcgttgttatcctgcttggaacttctgtcggcgccaccacaagcgcggaggcgtttctgaactgggataccatcaagatcgttatcctgggactgatcgcgtttgcctttggaaccgcggctggtgttgtctttggtaagattatgtgttacgcaaccggcggcaaagtgaacccgctcatcggttccgccggtgtttccgcggtaccgatggcagccagagtttctcagaaggtaggagcggaggcagatccgacgaacttccttctgatgcatgcgatggggccgaacgtagcaggcgttattggaactgcggttgcggcgggaacttttatggcgatattcggtgtgaaataagatcgaggaggagattgaaatggctgagaaaaaaccaattaaaataacagagacgattctgcgtgacgcacatcagtctctgatcgcaacaagaatgacgacagagcagatgatgccgatcgtcgataaactggacaaggtcggatatcattcggtagagtgctggggcggcgccacatttgacgcgtccttacgtttcctgaaggaagatccgtgggacagacttcggaaattccgtgatggtttcaagaacacgaagcttcagatgctcttccggggacagaatatccttggatatcgtccgtatggcgacgatgtggtagagtatttcgtacagaaatctgttgcgaacggaatcgatattatccgtatttttgactgcctgaatgatcttcggaacctgaagaccgcagtcaaggctgcgaataaagaaaaggctcatgcacaggtcgcgctgtcctatacacttggagatgcttacaccctggaatactgggttggcaaagcaaaagaaatcgaggagatgggggcggattccatctgtatcaaagatatggcgggtctgcttcttccttatcgggcaacggaactggtgacagctttaaaagaagcgacaagcctcccgattcagcttcacacccattatacgtccggtgttgcttctatgacgtacttaaaggcagtagaggctggcgtggacgtgatcgacaccgcaatgtcaccgttcgcgctgggaacatcccagccggcgacagaagtcatggtagagacattcaaaggcacgccgtatgataccggattcgaccagaagcttctatctgagatcgcagactatttccgcccgatccgggatcatgcactggaaagcggactgctcaatccaaagaacctcggcgtcaacatcaagacactcctttaccaggtgccgggtgggatgctctccaacctgacttctcagttaaaagagcagggagcggaagacaagtactacgacgtattggaagaagtgccgagagtccgtaaggatcttggagaaccgccgcttgtcacgccatcttctcagatcgtaggaacgcaggccgtgttcaatgtcctgatgggtgaacgatacaagatggcgaccaaagagacaaaagatattctgaaaggtaaatacggtgagaccgtccgcccgttcaacgaggacgtcaagaagaagtgtcttggagatgagatcaacgactgcattacctgtcggccggcggatctgattccagacgagctggaaacgctggaaaacgaaatgaaacagtgggagcagcaggacgaagacgtgctcacttacgctctctttccgcaggtggctgtggattacttcaaataccgtcaggcacagcagacgaagatggacgagacgattgcggacaccaaaaacggaagttacccagtataatcgcagagcttagtccgaaaaaagacagaatcctcgttttcctttcatggaatcacatacagattttcaaagggacatgttacgggataccggacatgtccctttcaaattgcagaacgataatacgatatgttacaaattttttttgtcctcttttttgtcgactcctgtgaaaagcttgtaattcattagaaaaagcggtatactgaactagctattgtggacttttggaggaaatgaattgtgacaggtaaaaatgagttgctggagagaattgaggatcggtatgataagatgagcaagggtcagaagcggctcgcggactatatccgtgcttcttatgagaaggcggtttttatgacggcatccaggcttggggaagtggtcggcgtcagtgagtctacagtggtaagatttgcggttgttctcggatacaaggggtatcctcagttccagaaagcattggaggagctggtgagtaaccgtctgaattttattcaacgcatggaggtgacttacggaagggtaagccagtcagagattctgatgagtgtgctacagtcggatattgagaagatcaagctgacgatggagcatattgatcagaattcctttgaagcggcggtggatatgatcttaaacgcaaggaaaatttatattgtggggatcagaagctgtgccgctcttgcgagattccttggattttatctgaatctcgtccgggacaatgttatcagtgtggatacaaacagttccagcgagatttttgagcagatcgtgcggattacggaggaggatgtgatcatcggcattagttttcctagatattccatgcggacattaaaggcactggagtttgccaataaccggaaagcaaagatcattacgctgacggatagcatccattctccgatgaatctgtattcgtcctgcagtctgattgcccgcagtgatatggcgtctgttgtagattctcttgtggcgccgcttagtgtaatcaacgcacttgtggttgcactttgtatgaaaaagcaggaagaggttgtggacactcttgtgacattggaggagatctgggatgagtaccagatttattcaaacgatgagttgaatccggtcagggatcaaatgtcaatccgctttccggataaagaataaggagaaccgaatggggaaaatagcagttgtaggcggaggagctgcaggcatgatagcagccattttcgcggcaagaaatggaaatcatgtagaagtatttgagaaaaatgaaaagctaggcaagaaactctacattaccggaaagggcagatgtaatctgacgaattcctgcgagatggaagagcttcttgaagccgtagtgacaaataagaaatttttatacagtagtttttatgggtttacgaacgaagagacgatggacttttttcggggaatcggcctcagaatgaagacagagcgaggaggccgggtatttccggaatcggatcattcatcggatgtgatccgggtgttgagtgaagagatgaagcgacttggagtccgggtacgtctgcatacggcggttcgccggattgtggaaaaggacggcaggttttcggcactgtatctcgcggatggtacgaaggtggaggcggatgcctgcatcatagctaccggcggtaattcctaccagacgacaggctcagatggagacggctatcggttcgcgagagagctgggtcatagtgtgacggcgatccggccggcactggtgccgttggagacgaaagaggcgtttgtaaaagaccttcaggggctttcccttcggaatacggctatcacgatcctggatgggaggaagatactctacgaggattttggtgagatgctgtttacccattatggtgtgagcggcccaatgatattaagcgccagttcctttatcgggaaaaagcttgaagagcggacactgaagctgcggatcgacctgaagccggcgctgacaccggaacagcttgacgcaagaatcctgcgggattttgaagagaatcaaaacaggcagttcaaaaacacactgtcaaaacttcttccatcgaaactgattccagttgtggtagagcttagccggatccaaccggaaaagaagattcacgagatcacaaaggaagagcggctaaggcttaccgctttattaaaaggcatggagattactatcacagggctcaggggatttaacgaagctatcattacccaaggcggtgttgctgtgcgggagatgaatccggcaacgatggagtccaaactggtagggaatctgtattttgcgggagaagtgctggatctggacgcaacgacaggaggatttaatcttcagattgcctggtccaccggaaatgcggcgggctcttgcgcatttaccgaataatcaggggagatcctgagaataaatacaaatatcggaggtttactttcatggggtatcagatagcgattgacggaccggcaggcgccggaaaaagcacgatagcaaagctccttgcaaagaagaaggggtttgtctatgtagacacgggagcaatgtaccggggacttgcctactattttctgagcagagggattcagccgcaggaggaagcagccattgccaaggcatgcaatgatgtaagcattgacattgcctatgaaaatggaattcaacagatctatgtaaatcatgtcaatgtcacatgccatctgcgggaagaggcagttgggaatatggcgtccagaagttccgggattgcggtagtaagagccaaacttctggaattacagagggatcttgctgagaaagagaacgtggttatggatggaagagatatcggaacaagcgttcttccggatgcggatctcaaaatcttcctgaccgcaagtgttgacacaagagcaagacgaaggtacaatgaattgttggaaaagggagaatcctgcgactacgaaaagatcgcatcggatattgaagaacgagacagaagagatatgacaagagacatctccccattatgtcaggcagaggacgcgagacttgttgacagctcggatatgacgattgaagaggttgtggagacaatagaatcgttctgccgggaatcagaataaacagaccaaaaccgggaaggaggagttgccgtcacacttcggaacgaagagagtagaaagacagagacgattgcaacttgtgcttgaaggagaaaagtcagtaacttataataagtgaagagcgaagagcaatcgcataaaaagattggagtaggatagatgaaccagtttgtagatattcactgtcacattcttccgggggtggacgatggttcccagactccggaagagaccaaagccatgcttcaaaaggcatgggacgaggggattcagatcatggtggcaacccctcattatcacaagcagagagggaaaaatgatatcgaactgatcaaaaagcagttacttctgacgagaaagcttgccaaagaggtgcatcccaaaatgcagatctgtctgggaatggagatctactatggggaagatgtgcccgagcttttaaaggaaggaagggtagtcagcatccggaaatccagatatattctggtggagttttcaccgggtgatgagttccagtatatcctcaatgcagtgagaaagcttcagatgagcggtcatacggtcatcattgctcatattgagcgttataattgcctgagaaaagatatttctaatgtagaatatttacgggaaatgggagcttatcttcaggtgaacacgggcagcattaccggaagctatggaagaagcgtaaagaaatttttaagagaagtattaaaagcgcatctggtacagcttgtagggacagacgcccatggctccgagcggcgtacgccgaagatgcaggaagcatacaaggaagtggtaaagcgctgcggagaagagtacgcagatcagatctttggccagaacgccaagaaagtgcttcgaaatgaagagatcgacgagtactaaacgagaatgaatttaggaaggtatagtgtttatggaagggacaaaccagaatgtgaaagaaaatgatgagattacgattgatctcaccgaattgtttatgacattatggagcaaggctcacatgattatcctggcaggaatcctgttgggactgttggcattcgtcggaacaaagctgtttctcacaccgatttacacttcgacgaccaaattttatgtgctgaataagacatcggatacaggaagcgtgacatacaacgacctgcagaccggaacccagttgacgaaggattatgcggagttggttaagagccgcccggtgttggaggaagtcatttccgttttgaatctcgatatggaaacagaagaactggctaagaaaattaccgttaccacaccgacagacacccgtgtcatgtccatcaatgtggaagatccgcagccgaagcaggcaagagacattgcggacgcggtacgtcaggcagtcagtatccagatcaaagcgatcatggatgtagattctgtacaggcagtagaaaacgccaatctgccggatcacccaagtagcccgagcgtaatgaaaaatacgctcatcggagcaatccttggaatcctgattgcggcaggtatcattattctggtctttatgcttgatgatactgtgaagaccccggaagatgtagagacttatcttggtctgaacgtacttgcgtccattccggtatacgatggaacaagcgcaaagaacaaaaaacgtgtaaaagggctctcagcccgcaatttccagaaaaagactgcgaaaaagtaaggtttgggaggtctgaagatgaaagaaatcgcattgaacttaaagagtatgcaggattatcggatcaatgaatcctacaagcaactgcgtacaaatattgaattttccggagaggagaacaaaattattgcggtcacaagctgcacaccgagtgaaggaaagagtaccgtatctttgtcaacggcatattctcttgctgaagcgggaaagaaagtactttttattgacgcggatttaagaaagtccgttttgaccggacgttataagatttcaggtgaaatgaaggggctgactcatttcctttctggacagggggatctttctgagattttatgcaagacgaatgaaaagggactgtttgttatttttgcaggcccggtaccgccaaatccggcggagcttctgggaagcaaaaagtttgcggcgcttttaaaagaggcaagaaacatctatgattatattattatcgacactcctccgcttggaagtgtgatcgacagtgccatcgtatcggctgtctgcgatgcggcaatccttgtcatctctgccaacacgatcagctataagtttgcgcgttctgtaaaagaccagctcgcaaagaccggatgtaatatccttggcgtggtgctcaacaaggtatctatgaaacagaataagtattacggcaaatactatggtaaatactacggacattacggaagcgataaataatcaaaataggagagcgtaagatgagacaaaggctattgacctttgctctggtagtcgggtgcgcggccctttttgccgtgtctgcgattcttaccatggcagaggataaaaaagcaccggtcatcacgatcgaagataaggataaagaaattacttacagagacggcgacgactatgcggagcttctggatggcgtcactgccaaagataacagagacggggatgtgacggatcaaatctttgtcgacagcattactgcggtaagcgatgggacaagagcgattgtccgctatgctgtgattgataagagcaataatgtcggcatcaagacccgagtgatcgattatgaaagcacgggagaaagcggacaggatgcaggtcagacagcagacaacgaggacagcaattcagaccagtctgaggcaaagagcgaggagcagaaacaagaggaagcaaaaaaggaagataccgcttctgatactgcgaatacagaagatacgaaagaagatacttcaaaggataaaacggacgcggagaataccaatgaaggtgagcttaagccaaacggtgtcaacccggcgatccgtctgacagaatctgcaaggacaatcaaagtgggagagacgtttgacattctttctgtgattgatcaggttgtggatgaccaggatgacgtatcggttctttccagacggattcatgcggatggacagtataatacttctgtcccaggtacatatacgatccgttactatgtgatggataccaacaataatacgtcaaatattgaagagtttacattgacggtacagtaggtaaaaaggggtgaatagaaatgccgcagagaagggaacaaagagagcggagaagacaccgaggctctcatcagtattacgatgagaaacggggaaaacataccctggggaaggtcctagcggttatacagcttctgatttccgtgatttttgtgggaattttatttaacagtggaatgattccgatgaaatatctggcagcaggtgctgcggtcctgttcgtgctgtttgcactgacattcggacttcagtttgccagaagtaaagtaaatcttatcggagtgatactgagtattctgatcagcgccgcgttggcgtttggaacctattactttatgaatatgcacaaggcaatcagtaatctggggggagctgagtataagaccgacaatatgattgtagtcgtaaagaaagaggacagcgctcagtcaattctggatacggagaattatatttttggagtccagacggcggcagacaggacaaataatgaaaaaatgcttacgaaactgacgacattgatcggtcaggagccaaatgtaaaagaatttactacaattcaggaggaagcacaggcccttctggatggaagaattgaggctgcaatctataatgaggcatttaacagtctgattgcggatgatattgaaggatatgaagaccagatccggattctctaccaatatggaatcgatacgaaactggagaaggtggatcagagtgtgacggaaccatttaatgtctatatcagtggaatcgacgtgtatggaccgatttccacgaacagccgaagcgatgtcaatatcattgcgacggtcaatccgaagacacgtcaggtacttctgacaactacgccgcgtgactactacgtgctcttaccgggcgtttccggaaatcagagagataagctgacacatgcgggaatctatggagtagatgtttccatggcgacgctggaacagctttataatacggatattaattattatgcgagagttaattttacttcgctgattgaaattgtagatacactgggaggaatcgatgtgaattccgagtatgctttcgaagcacagggatattcattccagaagggagtcaaccacctgaacggaaagcaggcgcttgcattttcaagagagcgtcacagctttgcatccggtgacaaccagcgtggaaagaaccaggaggctgtgattacagccattatcaataagatgcttgatccgtccatgctgacaaaggcgatggatattgtaaaagaactggacgactgcgtggagaccaacgtatccatggatcagctttccaagctgattcagatgcagctgaactcaggaggaagctggagtattctcacagacaatgctattggaacaggagattccaacacctgttattcatccggaagccagatgctctatgttatgaatccaaacgaggtttctgtaagcagcatttccagcaagatcaaccgcatcttaggtggagaaaaaattacacagtgatgactgtggaaaagaatgaggagtaaagtgctatgagaaaatggatgacggataagttatttctttatcactgggtacggatttccatcttactgtttatctatgacattatcgtgatgaatgtgtcctacggactggctctgtggctcagattcgatttccggttttctgatataccgtatgactatctcactacatgggtgaaatacattccaatccatacggcctgcacattgatcctgatgtttgcctttaaactgtatcggagtatgtggcggtttgcgagttttgatgaactttcccggacgagtattgtgtgtgccatttccatggcactccatatcgtagggacaaccgtcgtattccagagaatgccgatttcctattatgtgatgggtggaatcctgcagtatatcctgatcacgggtatccggttttcctaccggatcttccggatgctgaagatccgtacaacagcggcatcggtatccagagagatcaagaatacaatgatcatcggggcaggtgaagcagggcgtgcgattataagcgagtttaacaaaagcggtgataagatgcacacaaaaatctgctgcatcatcgatgacaataaaaacaaaaagaaccgttacatcgatggaattccgattgttggaacaagagaagatattccccaaatggtaaaaaaataccagatacagaagattatctttgcgattccgactatttctgcttccgagaagaagaagatcttggagatttgtaaagagacgggatgcgagatgcagattgtaccggcggtatatcagcttgtcaacggtgaagtgaaggtaagttctatccgcccggttgaaatcgaagagcttctcggacgtgaaagcatccgtatggatcttgcggagatttcagcctatgtcaaagacaagatcgtacttgtcacgggaggaggcggttctattggaagcgaactttgcaggcagattgcggcctatggagcgaaacagctcattatctttgatatttatgaaaataatgcctacgatattgaacaggagcttcgcagaaaatacccttccatgaatctggtggcattgatcggctcggtgagagatactggatgtctggaaaaagtattttccacttaccatccacagcttatcttccatgcggcggcgcataaacatgttcctcttatggagacaagcccaaatgaggcaatcaagaacaatgtatttggtacctataatacggcaagatttgccaatgaatacggtgcagagaaatttgtcttgatttctacggataaagctgtcaacccgacaaacatcatgggagccagcaagcggatgtgcgagatggtgattcagatgatgtcccgccattccaaaggcacgacctttgcggcggtacgtttcgggaatgtactcggaagcaacggaagcgttattccgttgttcaaaagacagattgcggagggcggaccggtcactgtcacacatccggatattatccggtactttatgacaattccggaggcagtatccctggtgctgacggcaggttcctatgcggaaggaggagaaatcttcgttctggatatgggagaaccggtcaagattctggatcttgccacgaatttaattaaactttccggactcaaaccgggagtggatattgaaatcaaattcacgggcttacgacctggggagaagctctacgaagagcttctgatggcagaggaaggactgcataaaacagataacaatcttatttttatcggggaaccgattgatatggatgacgacagattcctcatgcagctcgcagaactgaaagatgcatgttacaaagaagtgacagacgtaaaagagcgtgtgtctgagattgtaacaacgtatcgatataaaaaagaagattaatatctatctaaaggaaaaagtctaacggacataaaatatctgaaccaaatcaaatcgtcgctttgtcgcgtttgaatgggaaagtggtcattattgtatatcgtgcttcatctggaatttttccaggtgaaatggcgaagcataccctttttacttttcagggatttggaaagtaaaaagagtatgctttttttcatacaatcagacttttccgttacaagctctttggattttatccggcaaagccacatttgaagaaagaggacttctatgtggtatgtagtacaggtacgcaccggtaccgagaaagagatcatcacacaatgtgaaaaaaagatcgatcacgggatcttaaagcgttgctttgtcccttactatgaagcaatgaagaagtacaaaggagaatggcacctggaacggaaaatcctgtttccgggatacgtctttatgattaccgatgaggtagaatcactctatctcgaattgaaaagcattatcggacttaccaaactgatcggaacaggaagagaggtcattccgctcaagaaagaagaggtagatttcctgaccgcgtttggaaaagaacggcaggtggtcgaaatgtcgacaggaattttggaaaacggctgtgtccatatcacagacggtccgctgaaagggcgggaggccatgattcgcaaaatcgaccggcacaaacgcaaagcctccctggagattccgatgttcggaagaatcctggagacacaggccggccttgagattgtagaaaaaagataatagaaaaaggaagcttggaatattccaggcttttttagtgcaggaaaaggagtgagggaagatgacgaagagaaaaaatatcccattttcgccaccggatatttcggaaaacgaagtacagggggtggtagaagcattaaaaagtggctggattacgaccggaccaaagacaaaagaatttgaaaaaaagattgcggaattttgcgggacaagtaaggcggtatgtctgaattccgctactgcgtgcgaagagtccattttgcggtttcttgggattggagagggcgatgaggtcattacttctgcctatacttatacagcatcggcaagtccggtaatccatgtgggcgcaaaagttgttctggtagatgtcgcaaaagacagctatgaaatggattatgacaagctggaacaggcaattacggaaagaacaaaagcgattgttcccgtagatttgggaggcattatctgtgattacgaacgcatctttgagattgtagagcggaaaaaagcactctttcagccggaaaacgagattcagaaggcaataggaagaattgtggtcgtcgcagacgcggcgcacgcatttggtgccaggatgaatattcaagaggaatggaagcggtgcggatctgtcgcagactttacaagcttttccttccatgcggtaaaaaatctgacgacggcagaaggaggggcgctgacctggaaagagattcctggaattgacaatgagtggatatataaacagtttatgctcctttcacttcatggacagtcgaaagacgctttggcaaagacaaaactcggtgcctgggagtacgatattctggcaccatcttataaatgcaatatgacagatattatggcagcgattggattggcacagttagagcggtacgagggactgctgaaccggagaaggaagattattgagacttatgataaagcctttgaaccacttgggattcaaacgctgaatcattatgggaaagaacatgtatcgaccgggcatctctatttgaccaggattccggggattggaagagaagaagcaaaccatatcatagagaagatggcagaagaaggaattgcgacaaatgtgcattataaaccgttgccgcttttaactgcttataaaaatcttggatttcgaatcgaagattatccaaatgcatacagacagtttgaaaatgaaatcactttgccattacatacgttgctgactgatgaagatgtggagtatgtgacggcaaaatatgtggaatgtgtgaaacaatatttataaaaccaggagtgagaaagatgcggcagtatgatgtaaagattcttccattaacagaacaggagattgagaaaaaggttctctggtataatgatccagaaatcagaaagtatctgcattatacagattcatttaataaaaatgacagtctgaactggttacaaaggatcaaaaaaagtgatacaagaaaggaatatgtcatctggcttattgatgggcatatggaaattccggtaggaattatcggactgtttgagattgatagagcgaatcaaaaagcagggttttatatcacggtgggagaaaaacagtatcaaggaaaaggaattgcaaaaaaagcaacggttttatttttaaaagatatgtttgaaaaattcaaacttcataaaatatatctttatactgatgtagaaaataaggccgccagagggttatatgaaaaagtaggatttgttttagaaggtattctaagagacgaattgttttatcagaatcattatgtttcaagatgctactatagtattctttttgaagaatttatagaaaaatggagatagaaaaatgtttcaagaagttggaagcgctttacagatcgatattcaggatttgtttcaaatttcattgtatgatacccctgtatatccgaatttggaaaaacaatttgcgaagaagaatgtgcgatattttgaatctggaagaaatgcagtggagtatatctttcggttttgtatcccttcagataagaaggttgtcttactgccagaatttttgtgttccagtatcagtgatgcaatattaagggccggctggaagtttcagtattatactgttagtaaagatttggaaattgtagaagaggagatcgaagaaaaaattcaggaatatccggttttatttttcattgactattttggtaagaatcaatctcagaaatttttgaaaagacttaaagaatcatattcagagcttgttttaatagaagattgtactcaaagtataatgacaaaacgtacagaagaaagtattgcagattatatgcttgccagccttagaaaatggttcccgattccttcaggaggctgtgtttggtctaatcatagtcttccatcagttccaatgacttgcggaatcagtgaatacacattttactattttctttctcagattatgaagacagaatatttaaaaaacaatatgttggataagaaaaagtatttggaatggatgaacaagggagtcacaaaattatttgaagattattctattagagaaatggatcaggtttcgagacatttgcttgcaattatagactggaatgaagccagtcagaagagaagagagaattatgagatccttcacaatctgattcataaaaatgggaagtttgaaattgtatcagaactagaggaaggggaagtaccattttgtatgccggtttgtacacaaaatcgggatgatctgctacggtatttgattcgaaataaaatttattgcaatgttcactggagactctcagaggaacaaaaaagtgttagtccggaaataaaaaatctttcaaatcagattttgtcgatcccatgtgaccagagatatggtaaagaggaaatgaaatatatcggtcatgtattgaacgaatgggggatggggagagaatgaaaaaaattttaattgttggggcaggatttttacaggtgcctttgattaaaaaggcaaaagaatgtggattatatacgattgccgttgacggggatcaaaacgcaccaggatttttttacgcagatgagtgggaatgtattgatattacagatgaaacgcaatgtctggagtatgcaaaagaaaaagaaattaacggcgtcattactgcggcaacggattatggtattttgacagtagcaagaatcgcagagacgatgaatcttccaggaatttcttatgaaattgccaaaacagtaaaaaataaatatctgatcagaaaaaaaatcagtcaaaacgaggaactccaatttttcgaattagatacggaagaaaaagcacttcaactaagagagcaaattcgctatcctgtgattgtgaaaccgtgtgatgggtctggaagtaaaggtgtagaaaaagtggaaaacaaggatgggctgttggaggcgtttcaggaagcatatcgcttttcaaaatcaaaaaaagttctggttgaggatttttttgttgggaaagagtatggagcagacatcttcgtacacgatgggatggttgaagtcatggcacttcttggaaagcacattactccagaaccagactatgcggaattgggacattactatccaagtggattgaagaatgaaaaagaaatcaaagaaaagctgagacaggcagtgaaaaatcttggaattacgcatggagcagtgaatatggattatcttgtgaacggggaagaaatatttatcgtggatcttggcgcaagaatgggaggaaatatcatatattctcatattattcccgaagctaccggaagagactatgcaaaagagatgattatgcaggctgttggagaaagcacgaatcatcaacctctccataaaaatatggcggtagcgaccagattgctggcactgaggccgggggtgattgaaaaacttcctgatttttcacatattgaagcaaaatatggggtagagatttttcaccatcttaaagtaggagatacaatccataagtatcatacgaatctggacggtggaggatacattctggcgacagatgaggtactggaatatgcagaaaaaaaagcagagaatgctctgagggaaattgataatagtattttgaggagataaatgatgtatcagaacaaaataaaaagaattctggatctggctgtagcactttgtgtgctgcctttttttattttattgttccttgtagtagcaccattgatttggctggaagacaaaggaagtatcttttatcatgcaaaacggataggaaaagattgtaaacagattgatatgttgaagttccgcacgatgaaaatgcatgccccaaacaaattaaatgcggatgggagcacatacaatgcccaggatgatccaagaataactaaaataggaaaattattaagagaaacgagtattgatgaaataccacagattttaaatgtattaaaaggcgatatgagtctgatagggccaagagcgagtgaatactatgtgctggacacgtataaaaaagatgagctgcctaaaatgtgggttcgcccgggtataacaggttatactcaggcctattacagaaacaatttgagtgtgcgggaaaaaagattgcgggatgcgtggtatgcacagcatatcagctttgcactggacttaaaaatcgtttttaagaccgtttctactgtgctgaaaagagaaaatatctacacgaattaaggagatagtgatgttaggtgaaattagcagaaaaagtgcattttgggtattagatgcctgcaagggaggaaatgtcaggagacactatcaggatatagagaagcagttaaacgatatggcctattgcaaacagcaggttaataaaaatatgagaaaactattgcattttgcggtcaatgaagtggaggcatataaaccgtatcagggatataagaaattgtctgactttccggtaattaataaaaatatcattaaggaaaattatgaagcctttcagtctgatttatgtagaacaggaaatacgatcagtcttcatactagtggttccacaggaactccgtttgcaattattcaggatcgaaataagcgggatagggtaaatgccgagatgatgtatttctggaaaaaagcaggatatgaaatcggtatgaagtatgtttttttccgaatttggacagagacaaaccaaaaaagcagactcacagcatttgcaagaaaccttgtgatggaggatgtgctccgactggatgaaagtaacttggaacggatccggaaaagactaaaacaggataaaaagatcagaatgttgctcggatatgcgagcacgtttgaaaatcttgcatcgtatctgttgaaatgcggagatacgccggacatgtttcatatccggtgcgtaatttctggtgcggaagcattgatggaaagtacaagagaaaaactagttaaggtatttggatgtacagttgtctctctttattcgaatcaggaaaatgggatgttagcacaggaatgtgcctgtcatcgagaatttcattggaatagcagttctttttatttggagttattgaagctgaacagtgatgaaaaggcagaacctggagaattgggaagagtggtcattactgatttgtttaattatgctatgccgatgatccgctatgacacgggagatttagcagttagaaaacaaacatctgattgcggatggaatacgatctgtcttgagagaattgaaggaagaaaagcagatatcacgtatacagcagaaggagaaccgatatcaccatcaacatggggagtactattctgggagttcccggatattaaacaatatcagattattcaggagtccaggacagaatatgtgattcggatgaatgtagaaaaggataggtacgatgaagctaagttatatacgcttgtgaaaaatgttgtcggagacgtaaagattcaatttgagtatgtagacgaaattccggtgttaagttccggaaaatttaagagaagtatctgtaaaatacagcaataggagcagaaatgagaaatagagcaaaaagaggaatagtactagaacgatgttatgtttggcttacattcaaacatcggattttgttgagagaaaaagaagttcgtacgaatgtaaagcattgtaaaaatccatgcagagcacctgagaaagagtttcaggaagtggttttaaaatactggcgaaggtttggattgaagccagaaaaatattggttcgactggttcggtcagggggaaaatcactacaacaagtattttattccggataatatttggtacgagaaaattacgccttattttaataacctgatgtttaaacgagcaatcgcggataaagggatgtttgatattttgattccggaagttaagcagccgagaacagttgtaaaaaaccgtgctggaattttttatgatgggaaaggaaatgtcattacaaagaaagaggcgcttatactttgcatacaggaagaaaaatttatcgcaaaacctacattaggcggaggtgcgggaaaagatattcatttttatgacaaaacaaaggatacaaaagagaagatagagaaaatcttttcattttatcagaataattttattgtacaggaaattgtagaacagcatgaaattttaagtaatctgaatgaatcttccctaaattctatgagagtattgagtatcttttttcaaaatgaggttcacattctgtctgctattctccgtatggggcaaaaaggctctatggtggacaatgtttccgcaggaggaattcagtgtgggattcacatggatggaacactgtatgaaaaaggatctgataaatacggaaactggatcagcagacatcccaatggtttcctttttaaggaaataaaaataccttcatatgatcgtgttctggaaacgataaaaaagaaccataaataccttccgtatttcaaaattatcgggtgggactttgcgattgatagagaaggagaaccggtattaattgaatttaacgtatcacctgaacagaatcagcttacctgtggaccgactttcgggaaactgacagatcagattttggaagaggtatttgtgaaaaagacattgaaaggaagtgcagattaacatatgggaggggattacaaatgaatcaattatctgtaaaacaaagatatgaaagaattatagatatgatcaatcaaaatgtgaccgactatcctaaaaagagaaagaccattcgaattttgacggatttccttttagagaagatacgatataagaccaaaatgagtgattatattcagtacgaatattataaaaagccaaattatttaagaagagaatttattgatgaaaaccgtagggaaatcattcatcggattatgaatgacccgaaagactgtgaactgtttaataataaaacagagtttaatagggtatttacaaagtatttaggaagagactggtttgatactcaaaatgacacctttgagaattttcggttatttgtggagaaacataagaagtttttcgtaaaaccggcagaaggatggtttggaatcggtgcaggtatctgtaatgtggaggatgattcatcccttgatcaagtatggagagagctccaagagaaaaaggcactattagaagaatgtatcactcagcatcacgagctttcagaatttaatccaacatcggtcaacacactaagaattgtgacggtattatgtccggacaataacgtgaagattatgactgcggatctgcgtcttggacgaaagggaaaagttgcggataattttcatcataatgggattgcttctttaattgatgttgatacaggaattatctatacgatggggatcgataaaaacagaagaagatatattcttcatccggacagcaagaagcaaattattggtttttgtattccattctggaagcagattaaagaaacggttcgtgaagcggcattaattattccaaccgtccggtatgtaggatgggatattgcgctcggagaaaacggagaggttatgattgtagaaggaaactgtatggcggatccggacgtaacgcagatgccggacggaaagggaaaatggccaatgtatgtaccgattttaaaagctgtagaaaaaagtagaggaggaaaaagtaaatgagaacgataggttttccgattagtgataaagaaaatgaaaatagaagagcaattttgccaacagatttgatgaaaatcagacatccggagtgcatttatattgaaaaaggatatggaaaggttcttggaatcgatgatgaacagtatgtggcatgtggatgccatctggcagaacatgaagaagtgttagataaggatattatttgtgatgcaaaaatcggagatgcggggtatctgaaaaagttaaaagaaggaaaaactattttcggatggattcatgctgttcaaaataaggacatcaccgatattttgcttgatagaaaactgaccgcttatgcatgggaagatatgtttgaagaaggacgtcactgtttttggagaaataatgagattgctggagaagcggcaattatgaatgcttttcactgtcacggcctgatgccatataatacaaaagtcgcgcttttgggaaaaggcaatgtagcacgtggtgcgttaaaaattctgacattacttggcgctgatgtaactgtttatgaccgaagaacagaaagcttgtttcaaaaagagcttggtcaatatgatgtgattgtgaatggaattctttgggatacaaagcgaaaagaccatattatttacaaagaggatctcaaaaggatgaaaaaaggagcgatgattattgacattagttgtgatgctcatggaggaatagaaacaagtgaagcgacaactatcgatcatcctacatatgaagtagagggaattctgcattatgttgtagaccatactccttcgttattttataagaccgcatcccagggaatttcagaagaagttgggaagtatctggatgatttgtgtgaaagaaaggaaaatccaattctgacacaggcgcttattatgaatcatggaatgattattgatgaaagaatcaatgagtttcaggggagaacaatatgaaaaatcagacaatagagaggctcagagaaattaaatttgttgctctggccacattccgtttgccgaaacaaatttccaatattcaaaaagtgattgaaaagccaagttattacccggaaaagccaagaaaatcgaaacatacgatgtggattgaaaactttttgtggctgctgaaaaatcacgaattaaatccctattatacaagttacggattggatgtaaaaaattttaggaataaaaatgagtttattccgagacatgagttttgtagggaaagaaatataggaaatcaaagagtaaaaaatacaatttctggttcctataactatattgcacttttaagagataaatatattttttcagcttatttgtcttctacattgggaacggaatatcttccggagacgatcgcttttataaatggaagccgtgtatacgatgcaagaatgaaaaagtggattttgacgtcagaattttttaaagaagataagacagttgtttttaaattgattgatggcgaatgtgcagaaggtgtagccttggtatctgtgcagaaggggaagattgtcaaaggaggcaaaacaatagattggaaaacgtatttgcgcgagttcccgggagataaaattttagtacaggaagttttaaaacaacatcataaaattgcggagttaaatccatattgtattaatacaattcggattattacgattcgaggaaaatccggaaggattcaggtgtttgcggcatttttacgtttaggtgcgtcggaagattcttttgttgataatagggctaagggaggactgggcgtaggaattgatttatcaaaaggggttttaatgaagtatggattcgtccatgatgagttcggcttaaaagaagaacagcatcctcttaccggggtggaatttgcaggatatgaaatacctttttggaaagaagtagtggacttggttaaaaacgctcatgcacaattctattccctgcagtctattggctgggatatagtgattacagaaaagggccctgtattgctggaaggaaatgatgattgggaaattggaggacctcaggacacatacggcggtttaaaaaaacgctggaatgagttaagaaaagcttaatggagggtgcttgattctatgttgacattaaaactgcattatatcatcaggataaataaaagaacacttccttgtattgcattgtcgttatatctgttgcaggaaatgatttacgcgattttctccattgcttttggaggaggcggaaccgcaaggatatttacaatcattgtgatgtatcttccacttattgcaatgttgttttttcagggagataaaagggatgttaaggatttttatgttttaatggcgctaatagccgcctttttttgtgttacttatctttttcatccggaatactacgaatggttttttgaaggttcctatccgatcaagactgtgattttcagaccagatcaatgcatttttgcatacctgttttttcgtgtcattaaggatcctaaggatattttaaagacattaaagataacggcttatatcctgttgctttattatagctatcagctattacatgcgctatcggtaggatattggctgtataactctacaggcgaggtggaaaagtggagttataatttgaattatggttataatcatttacttgttatggcaattttcggatattttgcaatgaaagagaaaaaacttttttactggattctttgcggaatttctgtactagaaatcattttaggaggatcacgagggccgctggtgggagtgggtatctttgggatcctcctgattttacgtttcttcaaggaaatggatatgcggttaagagtttttttaatcgtggcaagcatctttgcgctcattctttttgtaggaataggtctggaaaccattttacagtgggtatcatctattatcaaaagtttaggaatttcttccagaacgattgatatgcttctgcaaggagaaatcgctgatgacaataatagaagcagaatttatgagactgcaattcagatgatacggaatggcggtttatttggatatggcgcttatggggatcggtatgttattggaaatatcgcttttgtcggatattgccataatattattttggaaattctgattgactttgggattctgttaggaggaattttctgcctgagaatgttttatgcatctataaagatcatgttttttgcccaggagaaagagtggggagacatctatatgattctatttgtcagtgtgactaaattgtttttgtcaggatcattttggtattcagaagctttttggggagcactggcggtctggatcagttacaaaaaggctgtgaaaaaaaagaaaagtcaaatggaaatgaagggaaacgaagaatggacaatagtacaaagaagaagtcatcaggggtagtcttaaaagcaggaatatggtatacggtcagcaattttgttttccgagggatggcatttataactactccggtatttaccagattattgacaaagggagaatacggagattttagtaattttgcgtcctggatgtcgattcttgttatcatcacatcctgcgatctgcaaacttccattatccgaagcaagctggaatttgaggatgatattgatagttatatcttttccatgcttggattgacaacactgattactgcgtttttctatgtagtgtttttagtctttgacgactttatttttaatagtattctagcgattgacaaaaaatatattcacataatgtttttctatttgttctgtgcacctgcatatagcatgtttgtaacaaaacacagggcattctataaatatagggtgttttctattatgacaggaatatctatagcattatcacttgggacttctcttattctggtcgtgatgatgaatgataaattgatgggaagaattatcgggcagtatattccggcagcgatcttaagcttgattctatatatttttcttgctatcaaaggaaaacgaattcagatcaaatattggaaatatgcactggtaatttgtattccgttagttccacatttactgtcaatgaacattttatcgtcatcagaccgaatattaattagaagaatttccggagccgaatatgctgctttgttcagtattgcacatagttgtgcgaatattgtatccattttattggattctatgaataaagcatgggctccatggtttcttgatacgttacattcgaaagactatagtaatgtgaaaccagtaacaaaaccgtattttctcttatttgtatcaatcgcgggaggaatttttctactagggccagaagtcattctgattttagggggaaaagcttacctcgatgcaatttttattttgccaccattgattatggggtgtgttgtacagttcgtctatacaatgtatgtacaggtggaattttatgaaaagaaaacaataggagttgcgattggaaccatctcttccgcagcgatcaacatcgtactgaatctgattttcattcatgcgttcggctatcgtgcggcggcatatgtaacattaattggatacatatgtttattattttaccattataattatgttaaaaggcttggatataaagatatctttgatagaaaattgttgtttggtacgttgctcattttgtttctagcaatgtttggaataatgattttatataattatacgatattgagatatataattacgttggtttatggaactgttattttatttttgatatttaaacaaaagggtattattttatctatattaagaaaatagggatggagaaattatgaagagaaaagaagttgcgaaattattattgttattaacattagtaaattctatagaaggttctcatattgttacaaatgcagcagatgagactttatatatggaaagtcagcaaagtataaacagtgaagaagagaaacaaaaggaaaatggaaaaaaagaatttgaaggatctgtaaaaaatcagaaagagacatccgtgacagagaaaaacaaaaagattgaatcagatcttgcaaattcagtaaaagaaaaaaatgggttaattgaagaaaatggaaggctatattattaccaaaacggggaaaaaaagaccggtttccagatcgtagatgggaaaaggtattacttcgataagaagacgggagaagcaaagtacggactgatcgatgccgggaacggatacacctattatttcctggagggcgggaagtggctgacgggcttacaggagatagaagggaaatggtataattttgcgggaaccggagggagtcttaccggatggagaacaatcgatggaaagaaatactatttcgacccggaagtaagatatgcggtaacgggaatcaagaagatcgatggtgtaatatatcagttcagcgatgatggagttctacaaaaggagattgtaccggggcttaccgaagaagatgggaaactatattattatgatgagaacgggaagaaaaagactggttttcagattgtagatgggaagagatattacttcgataagaagacgggagaagcaaagtacggactgatcgatgccgggaacggatacacctattatttcctggagggcgggaagtggctgacgggcttacaggagatagacgggaaatggtataattttgcgggaaccggagggagtcttaccggatggagaacaatcgatggaaagaaatactattttgacccggaagtaagatatgcggtaacgggaatcaagaagatcgatggtgtaatatatcagttcagtgatgatggagttctgcaaaaagagattgtgccgggacttaccgaagaagatgggaaactatattattatgatgagaacgggaagaaaaagactggttttcagattgtagatgggaagagatattacttcgataagaagacgggagaagcgaagtacggactgattgatgccgggaacggatacacctattatttcctggagggcgggaagtggctgacaggcttacaggagatagacgggaaatggtataattttgcggggaccggagggagtcttaccggatggagaacaatcgatggaaagaaatactattttgacccggaagtaaaatatgcgttaactggctttcaaaagatagatggagaaacttactatttcgattcagatggtattatgaaaacgggttatcaaaagctgaataataaccgatattattttgatcccgaaactggtaaagctatgacaggatttattacggtcacattttctgatggagattttttgttttattttgctggtgaaaaagggacgttgtccggcttgcaaaaaattgatggaggtacctactacctatcgtctatgggagaagtacagacaggatttcagattattaatggcggaaaatattattttgatgagaaaacaggaaaagcacaatatggccttattaaagctaataatggatatacttactatttccaagaagatggaaaatatttaaccggcttacaggttttagaggatgatgcctactatttttcatcaggcggcgtaatgatgactggatatagaaaaataggggacaagaaatattattttgatgagaaaacaggaaaagcagttatcggtttccgaacggttacgttttcagatggcgattttaccatttattttaatggcaaggacggaattttaactggtttacaaaaaatagggaatgatacctattatttgtcatcctcaggtacaaaaaagacaggatttcagattattagtggcggaaaatattattttgatgaggagacgggaaaagcacaatatggactcattaaagcgaacaatggatacacctattattttcaagaaggaggaaagtatttaacaggttttcagatcattgaagatcgtgcttactatttttcatcaggtggcgtgatgatgacaggataccggaatattgataataaacggtattattttgatgaaaaggcggggtatgcgattactggatttaagacggtggctttttcggatggagagtatacatattattttgatgggaaaaatggggcattgacaggtttgcagacaatcgacggaaaaacatattatttttctggggcaggagcaatgcttacaggtctacagaatataaatgataagtattactacttcgatgaagagaatggacaggcatataaaggctttaaacaactcagtgatggatatgtatattattttgatggaaagaacggagcaaaaacaggacttcagaaaatcgaaaatgatacgtattatttttccgatattggaaaaatgcagacaggtcttacaaggattgatggcaaacgatactattttgatctgaagacagggaaaatgcagacaggcttaattgatcttggtaataactgctatatgtattttctaaaagaaggaggcgtgttgaccggagctcagaaaatagatggaaagctgtacctgttctccgaatctggaatgccatatatcggatggcagacgattgacggaaaaacatactatgtagaaccggagacaaatgtagtgttgaccggattccaggaaattgaaggaagtaaatactattttgatgaaaatggtataatgttaacgggctatcagacgattgaaaatgagcattatctttttgacaaggaagatgggaaaatgcaaaccgggattgtggatgtagatggcaagaaacgatattttgctgatacaactggacaggaaaaaaatggatgggtagaaacagaaggacacttttattactttgatgagaaaagcggaatggcaaccggtttaaaaaaaataggtgatcagctttattattttggaaataatggtatcagaaggacaggattttaccgactggatgagaaggcctattattttggagaagatggaagtgcacagacaggaattttggatccggggaatggatatgtttactactttaagggagaggaaggagctcaaaccggtttagtcacagtaaatgggaaactttattatttcggtacaaatggagtccagcagacaggtattatccagttggatgggaaaaaatactattttcaaccagaagatggtagtgccgcaaaaggtttgataaccgtaaatggatatacctattattttgatgaaacaggacaggcacagacaggtttacagacaatccaccaggaattgtattactttaattcaaatggaatcatgcagaccggcttccagaaaataggagatacaaggtatttctttcatcaggaaacaggacaggcagagacaggattaataagtgcgaatggtgcaaagtatctgtttgatgggaaaaacggtgcgctgacgggactacagcagtataacggaaagacctattattttggaagtacaggagtgatgcagacaggtctgatcagagatacagaaaatgacactttatattattttgatactcaggatggtacagcgcagtatggttgggtagaaaataatggatattattactacctggaaaagggaggaaactataaaacaggtttccagatgatagatggaaagctctattcgtttatggaaaatggggtacgaagaagtggatatgtaaaaaaatcagatactgagaaatactattttgatagtgtatcaggagaggctcttaccgggatttttaaagtgaaagtcaatgatacagaagaatatacatattactttgatggagaaaacagcgttaaaactggtatccaggagtataaaggtaataaatactatttttcgtcaaacggaactatgagtaccggattgaaaatcattgatgataagagatatttctttgatccggaaacaggatgtgctgtttatggattggtagatgcccagaatggatattcctattatttaaaggaagatggaacttacaaaacgggtcttcagactattaacggaaggttatattatttttcgtctacaaatggagcttccttgactggtgacagaagtgttgacgggaagcgctactattttgatccggtataccgctatgccgttactggaattcaggaaatagacggaggcaagtattactatacagaagatgggcgcagattgtccaatgtcgatgaaatcgaagaggaacttaataaagaccatgacggatttgtatcgattgaaggcgaaacatattattttgagaatggatctatgcaaactggctggaaggatatcgatggaaaaagattttattttagcgcaaacggtacgatgcaaacaggattaactttgattgacgatgcctggtattatttgtctgataccggagaaatgcagaccggcctggtttttatagaatccagggtatatttctttgactcagagacaggaatgagtcagagtggtttggtgaaagatggagggaagacgtattaccttaacggttatggtggattttattccggaatgatagaatatgataacgctaagtactattttgatgagaaaggtcttatgcaaacaggagaaatcgttatcgaaaataaaaagtatcttttcgatcaggatacaggtaaaatgttgacaggaatccagactgttgggaatagcaagaaatattattcagaagaattaggatactgtatgaccggtttacaggaagtggacggaaaatactattatttcaatccaatcaccggagaaatgaagacaggcaaacagagtattggacagaaaacgtatttctttgatgagactactggggccagggtaaatggcttgcaggctgtaaacggggatggatcctactggttcaactcagatggaaccattcaaagagggttattctggaatgaaaatgatttatattattttaaccctatcaatgggaaaatgcagaccggaaaagtggaagttgaccaacagatatactattttggggaaaatggaaaagcagaaggaggagtgaaaacgatagatggaaaaaactattatttttcccctacgctttactatatgattaccggaaaagtacagattgaaggcgcggcatttttctttgaccaggaatccggagaacaactttctggatttgtgaaggatggaaatggaacatattattatgatgcaaaatatggtatggtgacaggagtatataagatccagaataaagagtattattttgatgagtcaaccggtaaaatgaaaacaggtattcagagaataggggacgatatatttggttttgatgaaaaaacaggggaaaaactgtttggaatgtcttctgtatctggaaacacgtattactttgacaaaataaccggaaagatgagcacaggatttataactgaggatggaaatcaatattattttcatccggatgatggaacacaggtaacaggatggaccgaaattgaagggaatgaatgttactttgatctggaaacaggaatcagacagcttgggtttgtcaaaattgatacagacacctactacctgaacgaaaagggaagagtgagaggggtgcaaaaaattggagaggaaatatatggtttttcttcctattatggaaaacttttgtatggttatcagaatatagacgggaagagatatttctttgatgagacagacggtaaaatgcagacaggacttgtcgaaatttcagatggagtctattataactttgctccggatggaggcgttttgacaggactgcaggaaatcgacggaaaacagtattattttgataaatggtactatcaggcaaagagcggattatattctgttggagataaattatattattttgatccggttacttttgaaatgataaaaaatgaagatattacaatcgaaggtatacagtatcatattgacgaagagggtgtggtttcattaaaggaaatgggagattccagaatgaaaaaggctctgcagtgggggttaaaacaactgggaacaccgtacagtcatacagagggagaaggatttgactgtgaaatgtttgtacagtttgcttaccgcgaagctggaattgaaattcctagattatgcggaagtcaggcctatcaggcatattatgataaggaaaggttccagattatagactctgttgaagaggcgaaaccaggtgatatctttttctatagagactatgagtatgaaggagtaagtgatgaaaaggataactggaatgaaatccatcattcagcattgtaccttggagatggaaaaatcttagaagcaactgcggccggagatggggttgtcagagtatatgatgtaagagaacagaggggctcttctgcatatctgtttatgattggacggtatatcgggaaataaactctataaaaagcaaacgataagaaaaagaaagggcaatatgattgaagcgttcaggagcaataatcatgttgccctttctgctttatcaattaaaaaatttccctttccttaacctgatgcaatatttcattcacaaacatttaaggaaatctttggtgttttgttcttgaatctttacgggattcggtatatcataagaaaacaccaaaagaagggagtcgcttttacggggagtataccaagacggcgagcagagaaaagaggggaaacttatgatgtggcagagcttcttggaaaaggcggtctggtttctcaagctgtacgtaagggaataccgctatttggtagcgtttttggcttgttttgtatttttttatattttgtttatgcactggatgaatattcggttttttcgggtcctgcgtgagccagtagcaattatatgcctgatcgtggagatcattgcgattgcctggtttacgattttcttccgggagcagggagattcccacacctatgagctggagttgttctggtcgtatcggaagtggattctggagggaagtgtgacttttggacttgagattttgaataatatcgtcttattcttcccatttgggtttattttgacggatgctcttcggagatgtccgttttgggcggttcttttggcatcaggtgcggtcagcgggtgtattgagctcagtcagcttgtattcaagcttggtttgtttgaattcgacgatatttttaacaatgtgcttggcgcagtggccggatggtgtgttttccatattctcagaagtctgaggcgcaggaaacccgcagaccgctacagagcctattgattttggccagagtgaaacagtgtattccgatatcgggaaagtgcgcggtgcaggatcatgccaaggactccacagctaatgagttcgccgattccgatagagaacatcagaagtgggagcgggagtgctatcccatatccgtagcggaggacaaacggtacgatcagcgtattagagaggatcggcggcaaaggcagcaggaaagagtgcttgtcccgcatccggtatacgaggacagctccaatcagtgttgcgagactgccgaagataatatccggcaggatcgcgcctccgaggatgttgccgatcagacacccgacgaagagacccggtacagcggctggggtgaaagcgggaagaattgtgagtgcctcggaaatgcggacctggatttcaccgaagccaaatggtgcaaagagccaggttacaatgatatagatagcggcgatcattgaggcatgagcaatccagcgtgtcttatggagtttcatgtgattcgttcctttctttatagtcagaaaccaggagcctgtaaagaaagcggtgcaaggggcgccgcagcaagttacagcttcctggctgaaatcattctgtagatcctattgtttctatattcagtgctatgtgtattacttagaactgaaacgcgtctttgagaaccggccagttctgatcccgttcattgagattcagtggtgtgccgtcagtgagtgtatatcctgcacatgcaccattccctggatatgttccggttaactgcggccattcaattccgatttccggatcattccacgccagtccgccgtcatcgcccggatgatagaagtccgtgcatttatagcagaattcagcatggtcggacagaacgagataaccatgtgcaaatccttctggaatataaaactgtttcttattttcttctgtcagttcgataccgtaccattttccgtaggtctcggagtcttttctcaaatccacagcaacgtcaaagacggatcctcggatggcgcgcaccagttttccttgtgggaattgcttttgaaaatggaggccgcgcagaacgcctttcgtggagctggactgattgtcctgaacgaaatccatgtgaagtcctgcctcttccatgtctttctgattgtatgtttccataaaatatccgcggctgtcgccgtggacggccggggtgatgacgcagagtccttcaataccgccgacatttttttctacagtgatctgtcccatatccatcgatctcctttcacaatcatagttactctaaaatttcagctccatgagataacggtggagcgcatctttccagtccgggagcggcgtgaatccatttgcggccagcttggatctgtccaggcggctgttaaagggtctgcgggcttttgacgcgccatattcttctgtcgtgaccggagccacagtcagatggtcagcatcgtattccgggtggccaagttcagaggcctgacggaagatttcaaccgcaaaatcataccagctaatatatccgccctcgttcgtggcatgataataaccatatttctctgtctggatcatatcggccaaaagacgtgccaagtcataggtgtaggttggggtgccgatctgatcgttgacaaccgtcagtttttcatgtgtctttccgatgtttaacatcgttttgataaaattcttcccgttttgcccgaatacccaggcgatgcggacgatgaaatatttttccagctgcccggagacggcaagttctccctccagtttggtttccccatagatattgagcggagcgtaggacttacagtctgcttcccagggagcggtaccctgtccgttaaatacataatcggtggagagatagaccattttgcagccctccggcttggaggcgtcgagtgccttcacaacatttacgatattctgcgttccgaccgtgttgacaaggcggactttctcttcctgttcttcggcaagatcgacagcagtccaggcagcgcagtggatgacaatatccggactttcctttagcagtactcgctctacagtatcagaatccgtgatgtctaaagagacatatcgagtccgtgtgacagcggtaccgtccatggctccgctgtagtacggcgccaggtcggatccgacacaagtatatgaggatcttccgctttcggtgcggcaggtcagttcatttactacatcatgtccgagctgtccggctacaccggttacaaatacttttttcatagtgacctcctttttgggatgcggatcccttagcggtttccgtacatctcttcataataattctgatattcgccggaaacaatggtttcccaccactccctgtttgtcagataccattcgatggtcttttgtattccatccgcgaattttgtctctggcagccagccaagctcctcgtgaatcttggtaggatcgatggcatagcgcatatcgtgtcctttccggtctgtgacataagtgatgaggctttccggttttccgagtgccttacaaatgatctttacaatgtcgatatttttcatctcgttgtgtccgcctacattgtagacctcccccacgtgtcctttgtgaagaatcaggtcgatagctttgcagtggtcctccacataaagccagtcacggacgttgataccttctccgtacaccggaagcggcttatcgtgcagggcattgataatcatcagcggaatcagcttctccggaaaatggtaagggccatagttattggaacagcggctgatggtcactggaagtccgtaagtgcggtggtaggcaaggacgagcaggtcggcggcagccttcgaggagctgtatggactacttgtgtggatcggcgtttcctctgtgaagaaaagatccggccggtcaagtggaagatctccgtagacctcatcagtagaaacttgatgatatctctggatcccgtatttccggcaggcgtccataaggacggaagttccaataatgttggtttcgaggaatacctgcggattttcgatggaacgatctacatggctttctgccgcaaaattgaccaccatgtccgggtgttcctcctcaaaaagtcgatagacagctttccggtctgtgatgctttccttaacaaaacggaaatttggattgtccatgaccggggcaagggtagaaagattgccggcataggtaaggcagtccaggcagatgatccggtagtccgggtatttgttgagcatgtgaaaaatgaagttggaaccgatgaaaccggctcctccggttacgataatattcataatgatagtttcctcctcatttcagatttaacgcagagcgtccagatatttcccatccagcacatcctttaagtactggccgtactgatttttctttaatacttcgtatactttcaggacctcgtctttagaaatccagccgtttaagtaggcgatctcctccagacagccaattttacggtgctgatgggtctccatcgtcttgatgaagttcgtggcgtctacgagactttcgtgggttccggtgtccagccaggtgaatccctgtccgagaagctccacatggagcgcgccttgttccagatagatccggttcaggtcggtgatctccagttctcctctggcgctgggtttcaagttctttgcgtattctacgacgtgattatcatagaaatacagtccggtcacacagtagttgctcttcgggtgttccggcttttcctcgatggaaattgcttttccctcagagtcaaattccacgatgccgaagcgttccggatcgtctacatagtagccaaagactgtggccccgtttccggcttccgccttttttacggcagcttccagacgtttcttcagtccatgaccggcgaagatgttgtcacccagcaccatggcaacggaatcgtctccgatgaaatccgcaccaataataaatgcctgggcaagtccgtccgggcttggctggacggcgtaggacaggtggataccgaactggcttccgtcctttaagagctcctgaaaacgaggggtatcctgtggagtggaaataattaaaatatcacggattccggcgttcatcagtacggacagaggatagtagatcatcggtttgtcgtaaatcggaagcagttgtttggatgtgactgtggtcaatggatagaggcgtgttcctgagccgcctgcaagaatgattcctttcatatgaacctcctttaactatagtaaactcatggtttctgacggtatacgttgtcttgatgatcctatcatatcaggtgtcctaagggcacgtgcaagtattttttcaaaaaagttttattattttgtgcagaggaaacatccggcgtcttttgtcacatggagggacggtgtggtcttctttttcacataagccgcaaactccttatagtgttccaaaatgtactggttctgattcccgtggcaggagagaatataagagatcagaggttccggttccggaattgtcaggtaatcctcgtactgcctccaggtaatctgggaaaaatgcggggccagaatgtcagtgccgttttccttcccaaagcaatcgtacagactggtggaggagagaacgatgcggtcgtcaaacgaggagacgagctgtgagatttccttcatatgttccttgccgtaagtgctgcacaaaaagacgccgcctggtttcaagactcttgcgatttccgcgctggctgtgtcaatgtcctcacagtagaagagaacgtgatttgcgagtaccagatcaaaggaggcgtcctcatagggaattgtctcacagttaaaagtacgaaaagaaaatctggaatcccagactttgtccgtaagaccggctccggtctgtctttccttctcaattacctggcccaaggtccgtctggcgtcccgcagcatcccgccagatatgtctgagagtactgcttccagacggtccggaatgaaagcgtagttttcagcccagaatgtggcgtttccacagcctacctctaacactcgctgcccatcggaaaaattagcctgatcaaagatccaggaaaaccagctctggttattatgggaaaacaaggagtgaagatggatgcgtgccgaaatattggaagcattctggtattgccttttcatgcttgtttccataccgagatcgtggatctggttgagcattttggtccagttgacggtctggtggctggagatgagctgtgtcgtttcctgaattgtccgagccacgatctgaagctgttcaatgcggtcttccaccagttttttctgaagattcagggaatctaccatgaaatgcgtatcggactcgttgattgtcatttccataatatcggacagagaaaaaccgagcgccttgaaaagcaggatctgctgcagacgagccaagtcgtcatccgtgtaaaaacgggttcgggtgttcggctccacataggagggctttaaaatatggtgttcgtcataataccggattgtttttttcgtgatgtgagcgagtttcatcaattctccggcagaataataaccttcttttttcataggagatgctcctttctttccttaattataaagaaaaatgaaaagagaggcaagctgggaatctggactgtataggtgaattgttacatgttaggcgagattttcggccgtaagaggtcttttcgtgggcagaaagttgtgttacactataaaatagataaaaatatttttgtcagcggtaattccgctgacaaattctataaaatagagaaggagagtagtggccggatatgaatgtagaacaattatctcagagaacaggatgtgatctacaggctgcgctgaggagactgggcggaatggaaacgctttacgaacgcctgataaataagtttcttgacgatcggacatttgaggaattaaagagtgcgatggaagctggagactttccaatgatagagacgaaagcacacacattgaaagggatcagtgccaatctgggatttgagacactgagccagaaaagcgatgagattgttaaagcagtgcgcgaggatcatagagaacagacggaagagctttttgaggaatgtgagcggttgtatgagcggatcgtaacagcaatacaagaagcagtttaaaagaaaacaaaagcgaaaagcggcgggaagcattgaaaaaacggtatggggaaagagaggattggtgaggatatgaatttacaggaagatggacagacagaggaaaagacagcaatcctcattgtagacgacaatgaaatcaatcgtatgatattgagtgaaacgtttcgggatcaggataagattctggaggcagaaaatggaaaagaagccttggatctgatccggcgggaaccgggtggaatctcagcgattctgctggacattgtgatgcctgagatggatgggctggagctgctggagatcctttataaagacggcctgacagagagcatcccggtctttctgatcacggcagacagttcagagcagaatacacagcggggataccagcttggtgccatggatattattgaaaagccaattgttccttattttgtgaaaaagcgtgtaggaagtgtagtagagctgtttcatgccagaaagcgcctgagtaatacagtgcataagcagcatcaaagacttttggctcaggagatggagatctacgagttgaataatgccatcatcgagactttgtccacagcgatcgaattccggagtggggaatccggcgcccatgtgaagcggatacgggagctgaccggtctgttcctgagaagactgatggaaataaggcctgaaaaataccaattcagtgaggacgagattgagatgatttctctcgcatctattatgcatgacgtaggaaagattgcgataccagaccacattttgaacaagccggggaaattgaccaaagaggaatttgaggtgatgaaacaacatactctcaaaggttgtgatctgctttgccagatccccaaatatcatcaaaatccattataccagtatgcatatgatatatgccgtcaccaccacgagcggtgggacggaaaaggttatccggacgcgctgaaaggcgatgagacaacgatctggtctcaagtggtggccctggctgatgtctacgacgcgctgacaaacgagcgggtctataagcctgcgtactccgcggagaaggcggcgtccatgattgtgggtggagagtgtggatgcttcaatccggaacttctggaatgtctgacattcattttgaaggaaacaggaggaagtatatgaagaggaaaagaaatgtctactggacgctgattctgtgtattatcattgcggcggtggtatttccgttcagtgtaaataaaatgcaggataccctgttaaagagcggtcagtctatgggggctgaaagtgcgtccaaatacggctccagagaagaaatgtatacggagcagtatgaatacatactgaatcttctggaatatcaactgcgacctggccatgcgattagtgatcttgaacagtttatgaaaaattttctcgaaatggctgacgagaccatggatttaaaggggatcgagctgtacgggtatattgatggaaagattgttgcggcgacgccgtgggaaggggacgcttcttatgatgctgccagtactgagtggtatcagggggcgttgcagacagatggtgtctactatacaaatgtgtacgaggatgcgcgtctggaagaggaagtagttaccatgtccaggcggatcgacggaacggacaatgtagtggcagcggatatttatccgagtgatctgacaaccagtatactggaggatctgccggagcagagtcactattatctctctgacggcgaggggaacctgctgaactggcatatcagtacaaaggggctttccagagaagaggttcaggagaaatataatagcttttttgccgatatcaaggcgggaaagcatgaggtatacgattcatccatcataggaatggatggaaaagagaggggcgtgtactattttattctggataatggctggtattccgtgattaccattccgttttccaagcttttggagccgatgaaggattcttggggaatcttccttcttgtgatgctgattttctttctgcttttagtaatgtttttaattttggagtaccgggcaaaacgcaaggcggggctttataatgacatcatgcgggtgcttgggaattcgtactatgcgctctatatgattgacctgagccagaaccagtattttatgctgaaaggttcagattatatcagagaacacctgccgaagaagggaagctatgatgatctgctggatgcgctcagagagatcgtggaggatgatacataccagcagtttcgggcagcctttgcctgcgataatatgatggaactgacgaaaaaaagagtccgtgatttcgggggagatttcaaacggatttttaatcaggaataccgatgggtccatgtgcagatgctctatgatgagtctttgcagcaggatacggtcgttcttggctttaaggatattgatgacgcaaagagacaggaactctcccgcatggaatttatgcaggaatcgcttcggtcggtagatcagatggcaaaatcgaagaatattttcttctccaatatgtcccatgatatgcgtacaccgcttaatggaattatcggcctgacaaacttggcgctcggaaatctggatcatccggaccgagtcgaggattcttttcagaagattaaaaatctcagtaaccagcttttatctctaatcaatgatatactggagatttccaaaatggagcagggaaaacttgagattcgtaatcagaagtttaatatccggacgaacacggaagaactggtttctatctatcaagctcagatcgttggaaagaagaaacagtttgacgttcagatcgatgttctggatgaatgggtcaacagcgactggaaccggatccggcagatcttggataatctgctttcgaatgcttttaagttcaccaaaacagacggaaggatctggttgactatcacagagcagaaggataataacagtaagtacggaaaatatcggattgtggtgaaggataatggagctggtatgagtcaggaattccagcatagaatctacgttccgtttgagcgtgagacgaaattcggtgcagcaaacgttgcagggaccggcctggggatgccgattgtccatgatctgattatcaggatgcaggggacgatagagctgaacagtattctgggaaaaggaacggaatttaccgtcatgttgccgttggaaattgcaccggaggaaacggccgcccagggagaaagaaacgtagaacgggagcaagagttttcgggtcagggacggaaagtcctgattgccgaggataatgagatcaatatggagattgcggttgagattttgaagatgtttgggtttaaagtcgtctcagcatggaacggaaaagaagcacttgaaatcttccagaagagcagggaacatgaatttgctttgatacttatggatatgaagatgccggttatggatggatgcgaagctacaaggcagatccgtcatctgaaccgggaggacgcaaagacgattccgatccttgcggctacagctaatgcgtttactgaagatattgccctgacgaaaaaggcagggatgaacgcacacatctccaaaccgatcgactttgaagtgttaaaaattacaattgccagacttttgcaggaataaacaggaaatgagttgtcgggaaattagggaaatctggaacaacagaagcaggtgtgattttatggaaaatcacacctgcttctacctgttagaaaaaaacggtattacctaacagatgacgattgtctgacatatgtccgcatgatctgttttttacaattttcgtttcagcatatccggattggaggcgtgggctaacgcctcggtgtctgagattgttcctgctttatacaatgccaaaaggctgttatccatggacatcatgtccttcccggaggaggaatagatcagtccttcgatttgatggatcttattctcacgtatcatattccgaatggcagaggtggtcgtcatcaattcaaatgccggaaccagttttccatcctgggacggtacaagctgctgggagacaaccgcatggagcaccgaggaaagctggacagagatctgtcgctgctggtttggaggaaaaacgtcgataatccggtcaatcgtattggccgcaccaagcgtgtgcaaggtggagagtaccaggtgtcccgtttcggcagcagtcatagcaacggaaatggtctcaaaatcccgcatctcaccaagcaggatgacgtccggactctggcgcagggaagcgcgcagagcagtaaggtagctctcggtatcggagctgatttcacgctggcttacgatacttttcttgtgacggtggagaaattccagtggatcctccagagtgatgatatgcttctcctgtgtacgattgatttcgtcaatgatacaggcgagggtagtggactttccacttcctgcaggacctgtcacaaggatcagtccctttttttgatctgccagacggatgatgggatccggaataccaagagcagatggatccggaagctcaaaagtaatgacccggatcacagcggagagagaaccgcgctgacggtatgtgctcacacgataccgggagagtccctgtaccgcgaaggaaaaatcatcgtctccggttgcaagaaaccgggaaatatcccgttttccagccagttcatagatctcacgcacgaacgtttcacagtcatgcggcatcatccgttccttaccggcctgaagaatcttgccgtttttcttgtaggagagcgggcgccctgccacgataaagagatctgaagccccttcctttgtcgtctgtgtcaaaatatcaagtacattcatttcctattcctccgataataactcattcatctcatcgctatccagaaccggaaccggtgtatcattgttccactcatgtgtgttttctaccttccatgctttaatctgatacagacctgcggtatccgatgatgtgtccgaagctgcatttgtaagcagaagtgagacaaacagacgctggttctcattgatggtgacatggtactgaagctggcttgcggatgagaacgagattccatcagttccatccagatctgtccgaacgttgtcaaggtaggccgaagaccctgcgtgccttgaaaggacagtggaaattttcagaagaatatcatttgccgtattttctgcttcatagtactcggtcgtccgtgtcgtattcttttcactcagcttgtagtctgcccgggcactcaccacggagagtaccgcaaacgtcagcagacagaggagaacgaagatcaggacgatcgaggttgttcctgtgctgagaaaagattttcttctaggctgcatcgtcagccacctcctttttggcagacggtacgaaacggatcggaagctcatagagtggctccttccccgtgtacgctacagagatcattgcgtgacgcatcccatcctcatcggaaatcttgatctgcatcgtgtagatagcgtcgtttccggagcagagggactgatcagcgtcataatagacgagaaacgcatctccacgttcttcggcatccggaaaatacgtggaaaaggatgaaaaagaaccatccgtatactccaacaccgaagccgcactagacgcctgagcggaagcaaagctcagatctttcgcacgcatactcagatcgtgcgctttaacaaaagcccgcacgcagacagcgcttccaatagcaaagaacaagatagcgattatcagctcgattaaaaacaaactggatttgctgctgtttcgtatactcattgtactcccccttcgttatggtttttctcggtgttcctggctgctgcgcagatgaagcaggcaggaggcagaagaggaaccagaatcagagactgtgatccttagaaatccatttccctcgtttacgagacggaacgtatctatttccaggatccgttcgccctgggctttggaaaacggggcgtcatctcggataaccagttcacagagccatccgtcatacgcataaatataagtcagataatcagtatcggtagtattctctgtattctgaagcacaagcactgtctctccttcctcttctgtcaggcggacgcctccggaggtatcatgctggcgtaccttttctgccacataagagagagcggtacgggcaacgtaattctcctccatctgcacggtcgtattccggtaaacgccggaaccaatgattaccacgatcagagctgatgcggcgaacaggcaaaacaaggacaaagtaaagaagaaatccacgatatgtccctgatttttccagttctttttcattttccgtcacctcctccttgcttcaaagcgatcacatcgatagaaggcatcaaattggaagcgctcacctcataggagacgacatatttatcttcgtcataggtcagaccatagtgctcttccagataggagaggctttccggataaaatccttccaaggcataacactggacggtacttctgcggactgcccgctccagactttcgagctcttgcccggaagttgtccgggtaatggaagaaagtccgtcaaaaaagaggaagaggacaataccgaaaactacgattgaaatcagatatttagcccccgcaagatgccggggacgcttcataaatcgattcataaactcctcctgtcaacgtatcatccgatattggacataattcccatgagtgggagcataacggataaaagaatcagtcctacaacgatcgaaaggattgccacaagagtaggttccagcttcgcgacgagatctgtcatccgggcgtcaatctcttcatcgtattgtacggaaatctgcttcatcacatcatccatagatccggtcttatacccgatggagaccatgcgggtgtagatgccggaaaatatactgcttttggttactgcatctgcaaaagacgttccctccagaatcagctcttgaatctgtttaatcttcgcctggatcactggatgttctacaagccgggaaaccatttccaggctctgatctgtatccagtccgctggaaagagagagatacattccgcttgcaaaccgggagcacgcgatcttttccatcagatttttcgtgaggaaaaaggaacgggcaaaagagccgatctgatggcgccccttcgctgtaaaagcaaagtagagaaacactgtggcaagcaggacagccagtatgacaagcagggcggcatagcgactgatcgtatttcccagggagagaatcgtcccggagatcccggtaagcccggtgccaagctgcctgaatacttcattaaaaaccggaagcacttttacaatcagcacaaagatgactaccatcatcataccaagcatgacaagcggataggtgacggcgcttttaatatttcttgccatttcctcttctctgtggtaatgctcggaaagagaagccatgacgtcgtccagacgtccggactgctctccgatctctaccatactgcaaaggtaagggggaaagactttggatgtaataagcgcttcatagagacttccggtctcctccatcgtcgcaatcatcccttttaacagtacggtgccatcgccttccggtgtatcctccagcatgatcgacagaccctccaaggaggaaatcccggatcttaggatcagggaaaactgactgcaaaacgtcgttaattcggtgttggataatgttttcataatgctcctttctccatttcgatgaaatctagtgcagatactgcatcgtataattggaaccatcgccgatatatttcagaatattttcactgttatcattgctggaggcaaaggtcgggtccatccttgtccagccgtccccggtaaactcaattagattatcgatccagccgatatcctcaatatatacgctgatccatgcgtgataaatctttcccgaatagccgatctccagacgggtcggaatattctgggagcgtagcatggcggtcgtcagtgcggcatagtcaaaacagatacccttcccggtggagagggtctcatctacatccgggagataacccgaaggaacagtctcggctttcttatcatcgtacgtcacatgttcaatgacaaagtggtagacctcgccaactgcatcaagatcagaagaggcgccctttaccacctcagatgcctttacgactgcctgggtatctcgagtaaaagaaatatactgattcggatataggaaaggcagaagctcatccgacaaactgacctcaatgctttccttgtataatgaggcatactgattgtccacaatattctcatatcccgccactgtgtatgagccgcttcctgctgtcagggggagggtgacgtgttgatcctgagcggaaataaagtatttgtatgtaatcccgtccggtccggtgatctggacgacagccttggcggcagagccgtcatacagtgccataagatatccttgatcgatatgagaaatatccagagtcaggggcgaactgccaatcaaagcggttcctgacgcctcagggacatacacgtgcggggcatttgggcgggtaccgtttttctttccctctgcgccatgaagggaggagtctcctttctgggaacagccggaacagataaggacaaggcataagattagcccgcacaaaagcagaagtctatgttttggtttcataaaagaaaactccattcctaattttgaaaagaccgcagcctctcagccagatgacgtttggaagatttcagataacgctttactgaactgagcgagcaattcaggaagtccgcaatctcttcaagcttgaaatcatggtcgtaccgaagaagaaacgtctggcgctcctgataagaaagcgaatccagtgcttcacggtagtgttccagaaaatcccgatccgagatgtcccggaaacagtcatcgtccgacggaatattcagaaccttcggatcactggaaaaatctgtctgctcatatgactggctgcgtaccttgcggagaaaatcgcaacagacatggtaggtgatctggttcatccatgacaaaaagagtgaatcttctttcagagaatctatattcttgtagatgagaatatagatctcctgcactgcatcctgtgccagatgaggatctttcaaaaactgtagtgcgtattgatcaatctttttatgtgtgtaattgtaaagctccgcgaacgcttctttatcacgtttacggataaaccttgcgagataagtaaggtatttggcgtcaaatgatttatgtatcatcgttaaacctcttgacattctaaagtaaaattctgtcaaaaccataagatgttattttagtatatcatcttaagtaacagaaaacaaggcaggaaaaatcggttctcttttcccgccttgcatcttgtatgttttcttttttattcttccgcacctgtcccaattcccggatgcaaaacagagacaagctgattctggttgagatccggaatcacaatgtacatatcctcggaaggataagggaataccacaagtccctccgatggttcacaacaggtcgggcggatcatgtccgaagaatctgttctggcatagattccgttatagtcgatgccggaatcgccgatatccttcacgtgaatctcaatattgtccccttcatgggagtgggagagtatgacgggagcctggtcatcaatggaatcaatcgatatctcttgggtagcgtgaattcctgagatcgaaacgacgtccagaaggagatatccattttcctctacttcgagggagtagtcctgattgccaagtacatctacgtcgatatctttctcattcagagaagcattgacttggctgacagggaagagcgcgtccacatggaaggtgacctttgcgctggaagcgtccgatgatggagcggctttgacactggagatcgaaggcttctgaacgatacctgtcccactgaagacgaaaagcccgacggctgcggcggcgagcatacccttgattagacagcgccggataaaccgtgctctgtatttcatgccggaacgcggggaacaggaaggatccagatccaggtcagtcataatacactcaaaaagctggcctgtattcattttatcgtgaagaaaatcagatgtttcagatgtttggttgttacggttgttctcttcgtgtctcatagttttacgtttcctttccaaaagatggtctaaggtatccggaaaaaccggtatcgggtcatcatgtacacaatcggtattcttgataggtttcatgataaataaaacaaaacgatctgtcaaatccctgcttaggaagttctggatgaggaatggaacttaaaatgcaggaaaaccatcaaaatttgcccttatataatatttagacgcaggaaacatgtaaaaaggttcacaaaatccgaaaaaaagtgaaaaaagtatatagatgtgcggattcgccacaaataaaggaaaatatttccagttttatgaaactgcagtacaaagccacattggaaatacaggccttttgtaaataagaaaaaaatatgtaaaaaaaattaagaaaatgtgaacctttttagtattgcgttacgtctttatataatgtagggcgaaatttgtgccctgcgtaccattatgccgtgaggcatcagtggtgaaaaaatctaaaaggaaaggaggggaaaagagatgagacgagcaaaaaggattacagcattagcagtagcggctgcgatggtgttatctaatgtcgcatatgcggcaccggatacgaacactacgaccacacaacagggtgccgaatctcttaattcccaaagcgatgcatcgggaggcgtaaaggaccaggcatctgacacgaagggcaacacgagcacctcagcttcgcagagcaaagagcaggtgaaacagaatgaaagctcgcagagtactgacccaggtgaccagaagcagacggactccaaggaagacgtcgtttctcagaatcaggatcagaagaaggatgaagattcaaaagaaacgcagaagccgagtacggaagctgatagccagaagagtgaaactcagaatgtggatgcagataagtctgaagatacacaggaaccttcaaaagaacaagaaaaggtcctctatgatatcacctttgatacgccggaaaagcacggtagagtgaccgatttggatggtaaagaagtggctgacggcaagactttgaaaactgacgaaaatggtaaagcgaagtttaaagttaaaccagatgccggatatcaggtacaggctgtatatcagatgcctgacgaacagacaccgctcaagctggtgaaagacagctactacgaaatgcaggtagaaaagaatactactgtcaaagttgtatatcagaagattcctgcaagtgaagaggaaagtgacggcgaggatgacggagagacgaaagaaaccgacaccaaccagaacgaagttcagactccgacaaatgaggatgaaacaaataaagctgctgagtcaaccgataaaaaagcaacaactcaaagcgatgagtcagacacaacaggtggtgagccaagtgctggtgacacaaacggtggaatctctgcactgactatcagcggtaagaatgtagtgtatgtgggtgaagacatcacactgacttctgatgagagtggtggttggcaacatcagtgggaagctgattctggctatgttactgtaaagaaaaatagtgacactaaggcaacagttacaggggtaaaggccggaactgccacgatcacacatagttggaagacaggaatcccgatagtaggacagaagtcccaccgcgagacttttaccgtcactgtagtgaataagcttgtaacaagtatcgaaatccagcaagattccaagaaagtggaaagcctttctttgaatactggcgatgaagccactctaaaggcagtagttaaaccagatgaagctacaaacaaaaacgtaacatggtcatcaagtgctggagatgtagtacaggttgataatggtaaactgaccgcggtgaaagcaggcgaagctaggattacagcgtcagcatcagatggatctggtgttaaagccgaggtgaaagtcactgttacagatgtagcagtaaaagaaattacagtatcaggcgaagtgaaccaaacagtacttgaaggtggaaagatacagcttgctgtaaacttcgtaccggagaatgctacaaacaaaggactgaaatggaaatctctgaattcagacattgctaccgttgatgaaaatggaattgttacaggtgttagaaatggaacagcaacaattcaagcaacgtcagttgtaaatcctgaagcagtagctacatttagtgtacttgtagaggaaatctacatgacagaatttactgttgttgcagaccgcacaacggtaacggtaggcgatacagcaactgtccgtgcgatcatcaaaccggatgagtatccgaacaaagaggttagatgggaatccatggatccaacagtagcaacagtgaatgaaaacggagttgttacaacaaaggcaactggtccggtaacgattaaaggtacctctaaagcggatccgaacagcagtgcaacagtaacaatcctggttgaggatgtgaaggcggaatctgttacgattagtggttataatcagaactacctgacaagtggaagtactgtaacacttacagctactgtaaagccggatgctgcggcaaacaaaactatcgtttggagtagttctaatacagatattgttacagtagatcagaatggtaaggtgactgcaaaaaatcagggtacagcgacagtaagggcactcaatgagtacacgggtctctatgatgaagtagagattatggtatacaatagagagccacaaacagtgaaggttcatgtgtgggtaaccaaccagttgaagacaactgtaaacattaacctgccgtcagatggaaagccagttactttaacggatgtacttccgacttacgtaagttccgacagtgaggaatatgtttattgtggtccagtttatattcataattatccaaatggaacaggttgggaaagtatcaaagctcagcctaaagccgtacgtttgagatatttaaataaaaatgtgcagtattctacatcattggatggacagtggaataacctcggaaacaataatgtcaacgcacagtatgaactactctattccggcaatgaggaagatgatacggatgtaaacgttgtagtaggtgattggccatatactgacggaacaacgacaaataagattctccggataagaatctataattctgaaactggaaaatatgattatgatagcggtagtatgtactatgataatggatcaaatggcgcatatggtaagataaaatttaattgtgatgaatccagatatgaagtagctaagattactgttgaaaaatatgacagtcgatacagtgatcgaccttcgtctactacaaatgtcgaagagcccgtttcagttgagttccataagaaggaagaatatgagcggtatgttgtaaccgcaacggtacaagcgaaagagtttactgtacactatgacagcaatggtggttcaaacgatgtacctgaagaccagaagattaaagcaattaacggtaacaccgttacagtagattccagtccacagcctacaaaagcggggtatgtatttgcgggatggagttatggtggtaagacatactttggcggagaagcatttgagatgccggcaagtaatgtaacctttgttgcgaactggatcgaagccagtcaggcgatcaactataaggttaacgatgcagctatgggtactgtaactcggtcttatgagcgtgtgacgagccaaacaagcattgaagatttgcaggggtctttagcaacgcctaaggacggttaccattttgttaaatggattgatgaaaaaggtcagatagtttccaaacagcaatattttaaaccgactaccccagagccagcaacatatacagcggtatttgcaatcaaactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagataaagatgtcacaaagaactacagcattagcaaggtaacagacggttacgtaaagattaatgcggatggactgaatgagacagactttgaagtcagcggactgagcaatcatgtatatgacggggaaaaccataaagatgtgccggttgtaactaagaaaggaagcaaagacgcattagaggaaggaaccgactatacagtaagctacgacacagagaactttgtagacgtcaagaccattaccgtgacgattactggaaaagggaactacagtggagtggtaaccaagacataccagatcacggaacgcccgattgaagtaaccggaaagcaagaagaattcacatatgacggaacgctccataaggtagaaggcgtaacagcaaccaacctggtggaaggtcataagatcagcagcaaagacgcagtagcggagcggacagaggaaggccagaccaacatgggcctgacgcaatccagcagctatgagatcaaagacgcaggagacaaagatgtcacaaagaactacagcattagcaaggtaacagatggttacgtaaagattcaacgcaacacaacagacctgaagtttgtggaagcagagacaacaggttacaatggagtgtatgacggagcagcgcacgatgcggtaaccagcgtgaaagtcacaggagtgaatggggaagagatcgcggcagaagacatgacggtagagtaccggctcagtgatgaggctgactggggcaagacgccgcaggtaacggacgtagcggacagtacagcggtacagatccgtgtaaccgtagcgaactacgacccgatcacaacaaccgtgcaggcaacagttacacagaaaccagttactatcacaacagaatctgcatcaaagacctatgatgcttctgcacttactgcacctggtgaggtagagggaatcgtagaaggcgaaacctatggatttgaaataacaggttcccagacattagttggaacttctgagaactcctatgttatgacttgggcaggagaaggcaacgagtattctgctaagtcagataactacacagtgacagaacgtgttggtacacttaccgttactgatggttccgaagaagagccgattaatccggaggatgttgtgaagaagacacatggtacaccggaaggcggcgtctacaaagctggcgatgttgttacgtttacggtgacagcaacgaacatctacgatgaagtgaagaccattactctaaacgaaattgcgggtgttaccctgaaagacacagtatttgctgatgtacagccgggtgaaaccgttgaaacaactgcaacttataccatcacagaagctgacgttcttgcaggcgaatttgttaatactgtaactgcatccttcagtggtgaggaagatacaccattcgaggatgacgatcaggtagatgagatcgaggaaccgaaaggccacctgaccatcgacaaagtaacgacaagtgaaccggcaaatggaagcagctatgcgttaggtgagacaattacctataaaattactgcaacaaatgacggtaatctgaccttgacgaatgtcaaagtagtggatgaactgacaggtgatgagtgggagatcgcttctcttgcaccaggcgcatccgaagaatttgatacttcttacacagtaaccgaagcggatattcttgcaggaagcgttgtgaacactgcgacagcagagggaacaagtccggatccggataaaccggatgtaccggtaaatccaggtgaagaagaagagcctaccgagacagaaaaaccaagtctgttcgtagaaaagacggcacagccggatgaagacggcgtttacaatcttggtgacgaaattcattacgtcattaaggttacaaacaacggaaatgttacggtgaatgatattactgtgaaggatgaactgacaggcgatgagtggcagttagacagtcttactccgggtgagagtgaggaatatcatgctacttatactgtaacggaagaagatattctggcaggatctattacaaacgtagcgacagcagagggaactgatccggatgaagatccggttgatcaggaaggtgaagagaccgttccaacggattcggcagattcgcatctgaccatccataaggctacaacaagcgatccgggagacgacggtgcttatgatcttggtgataccattacgtatgagatcattgcagccaacgatggaaatgtaactttgaacaatgtcattgtaacagatgagctgacaggtgatgagtggatcattgaaacacttgcaccaggcgcaagcgaaacatttgaagcagagtatgtcgtgacagaagaagatatccataacggcagcgttgtcaacgaggcaaccgcaacagccgaaggcccggaagagcctgtcattactccaggtgaaacagaagatgaaaccaatccggaaaatccaagtcttacagtcgacaagagcattgttgaggaaaaagacgagtatgagatcggtgacgtcatcgaatacgaaattacagttgctaacaatggtaacgtaacacagaatgatgttcgtgtaacggatctgcttcaggcagccggagacattgtgatcacaggcgtagaaggagcagacggggaaatcgatggggcaaatgtgacattggattctcttgcaccaggcgaaagcgcgatcattcattgtgagtatacggttctcaaagaggaccgtggcagcacgattaccaatgctgcaattgcggatgatgaaggaaaaggcgatggcgaagaccctgttacaccggatgtaccggcagaagtagcagatgtctatgatatcaacgtagtgcatcagttcgcggatggtgaagaaggagaggcagaattgccggatgactatacgattgaaaatcagccggttggaacagaaagagaaatcactgcagaaacggtagaaggttatacagtatctccggcatctcaggaagtgacaatagaagacagtgatgtaacgatcactttcgtatactacacagatgagatcggaacagatcctgaaaacccggatacaccggacaatgtaccggatagatatcaggcagttgtaacatttgaagcagtgaatggtacggttgacagaagcgcggcagttgttactcttatgagaaacggacagcctgcagaagatggaatcggttacctgacagaagatcagatcgcgacggcaagagcaaatgtcggttatgcgcagaattctctgacatggagtccaggaacgccgacagcagaatataaagtcactggagacatgacgtttacagcaagcttttctgcaattccggttattccgggggatggtggcgaagagccagttgaaccaacaaatccaacgactccaacgacacctgcaagaccatcaacaccgacaacgccgacacttcctgtcacacctgcaaatccgggaaccactgtgacgccgacgcttccagtgacgccacagacggctgcaccggccgcgcgggtttacgcagatggtgttgttgttgatgatccacagacggcaacagacgattacgacttaaatgaagtagaacgtgatgctggaacagaaaccatcgatgaagacagcacaccgcttggaaacatggatctcgaaaaagacgatgaccataagtgctgtatcctccatttcattcttctcttattggcgctgatcgtggaactgatttacacccatgatcggaaaaaacgtcaggaaagaatttttgaactgagaagagaattggcagatttcgatgaaactgtgtagggaaacaggtacttgcaaaaaggaggcaaacagtatgtatgaatttgttcacacaaagttaggcttctgcttctgggatattcccgcactgattgtactgattgcaatcatcgcagtctttgtagtacacgtcatcagacagaaaagacgtgaaaacgagtttgaagacgaactctcagacaagatggcgcagaaagcagcggctgaaaacgcaaatcaatagtttattttaggggtggggcgtgttccaataggaacacgcttcatctataaaaagtttgacaaatagttcggacatttctttttgagactatcagagcttttaaaactttcttttatcattctttattgacatatgcaaaagacagacgtatacttacaatccattatcggacatgatccgcgatgtccgccgaaagatcaccccattcggggaattattccaagtatgaacatacagtgaatcaacacacaaggaagtggttatcaaagacagttagtaaaaacacaaatgatcctgttggaccactttctgtttgcggaactgatggagaatttttctgaagtccagatcactggcttttttgagagtctcttgacgtgctcttgctttttccgttataatacacggagaaacgtataaaggggaagaggctgtggagaagaaaaagagaatttggacagcgatggtgctgatctggatggtcgtgatctttatgttttcagcaaagcctgcggatgaatcttctaaggaaagtctttttgtgggccggatgatcggtcagatttttatgaaagattttggcgagtggacaaaggaggaacaggaggcgtttgcggagaccatcaattatccggttcggaaagcggcacatgcgacagaatatgcggtcctcggaatcctggttctggtaagatgcaagtatcagaaaaaatggaatagaaagcgtatgattttgacggcctgggggatcagtacaatgtatgcggcaacagatgagattcatcagttgtttgtaccagggcgtgcatgcatggtgactgacgtaatgattgattcagcgggagcgctgacggggattctgtttgcctcagcgcttgcagctattattataggtagaaatagggaacaaaaacatcagaaatgaggaaacaaaaatggaaataaagcttgcaaaaagcgcgggattctgttttggggtgaagcgtgccgtagatatggtttacgagcaggcacaaaagagagaggaacgcctggacgccggggaagagcaggtgccggatatttatacatttggtccggtcattcacaatgaagaagtggtgaaggacctgaaaaaaagaggagtgaaagtactcaggacagaggaggaactgaaaaccctggaagacggtattgtgattatccgttctcatggagtcggagaacatatctacgagacgatccgggaaaagggtttggaatatatcgatatgacctgcccgtttgtgaagaaaatacataacattgtaaagcgggagagcgaggcaggaaagtacattattatcatcggggatccgaatcatccggaggtgatcggcatccgtggatgggccggaaagcgggcttgtgtgatcgaaaatgagaaagatgcaagggaattttgcctggggaatacagaattagatgatgagtcagataataaaatctgtattgtctcgcagacgacatttaattacaataaattcaaatatttagttgaaattcttttgaaaacgaggtatgatataagtgttttaaatacaatctgcaatgccacaaaagagcgtcaaacagaggctgagcatattgcaaacgaagtggacgcaatgattgtgatcggtgataaacacagttccaatacccagaaattgtttgaaatatgtaagaaggcatgtgaaaatacgtactacatacagactcttgacgatttgaatatgaatcaattaaagttaaagtccgtggaagcagtaggtattacagcaggggcatccacgcccaataatataattgaggaggttcaaaataatgtcagacttaacttttgaacaaatgttagaggaatcttttaaaacaatacacaatggagaggttgtagaaggtacagtcatcgatgtaaagccggatgagattatcctgaacatcggatataaggcagatggaattatttccagaagtgaatatacaaatgagccgaatgcagacctgactaccatggtaactgtaggagattccttgacagcgaaagttttaaaagtaaatgatggagaaggacaggtattacttacttacaagagacttgccgcagaaaaaggaaatgagagacttcgtgaagcttacgaaaataaagaagtattaaaggccccggttactcagattcttggtggtggactgagcgttgttgtagaagaggcgagagtgttcattccggcaagtcttgtgtcagatacatatgagaaagacctgagcaagtatcagggacaggagattgagttcgtaatcagtgagttcaatccgagaagaaaccgtatcattggtgacagaagacagctactggtagctgagaaagcagagaaacagaaagagctttttgcaaatcttcatgcaggagacactgtggaaggtattgtgaaaaatattacagatttcggtgcgttcgtcgatcttggcggagtagatggtctgcttcatatttccgagatgtcctggggacgtgtcgacaatccgaaaaagctgttccatgtaggagatacagtaaaagtactggttaaagatgtgcatgatacaaagattgcgttatctctgaaattcccggagacaaatccttggctccatgcggctgaggactacgcggttggtaatattgtaacaggtaaggtagccagaatgacagattttggtgcttttgtagagctggtacctggcgttgacgcactccttcatgtatcacagatttccagagctcatgttgagaagccggcggatgtactgaaagtcggacaggaaatcacagcaaagatcgtggacttaaacgaagaagaaaagaaaatcagtctgagcatgaaagcgttagagccggctgctgaggagacgaaagaggaaactccggcggcagagtaatatttgccggttttgatgagcgtatagatgttgcattgtaaaaatagaggctattcgctttagtctctattttttcatgtttaagtatatgttaaaaaatgaacgaggaggaaaaaaagatgggacttttaactttcaagggtggtattcatccgaatgatggaaaaagtctggcaaaggataaggcgattgtcgaagtcctgcctgaaggagatctggtctttccgctttctcagcatattggtgcgccggcggctccgattgtcaaggtcggagatcaggttctgaaaggacaaaaaattgcggaggccggagggtttgtctctgctccggtgtattcctcggtttccggaaaggtaaaagcgattgctccgtattttacaccgaccgggggaaaggtttcatccattatcgtggagaatgatggggcctatacagaggctgagagactttctaccagaccgttggagatgctttccaaggaagagattctgaatttaatcgctgaggcagggattgtcggaatgggcggagcaggattcccaacgagagtgaaactttcaccgaaggaaccggaaaagattgaatatgtcatcgcaaactgtgcggagtgtgagccttatattacggcggattatcgcagaatgatggaaaacccggaggatcttgtagaaggtatgcgtgtcattctgaagctctttgacaatgcgaaggggatctttgcggtggaagataataagcctgattgtattgagaagctggaaaaactgacgagcggtgagccgcggatggaagtagccaagctgatgaccaaatatccgcagggcggtgagcgccagttaatctatgcggtgacgaaaagagcgatcaattcttctatgcttccagccgatgttgggtgcgtggtggacaatgtggagacgatcatccacatttacgatgcggttgtcaacggcagaccgtgcatcgaccgtgtggtaacggtcagcggagatggaatcatgaatccggggaatttcaaagttccgcttggcatgaaccagcaggagctggtcaatgtggcgggaggatttcaaggtactccggagaagattgtttccggcggtccgatgatgggatttgccatgtttacactggatgtccctgttacaaagacttcttcctcgattctgtgtatgacaaaagacgaggtggcgaagtacgaaccatccgcatgtatcaactgcggccggtgcattgaggcatgcccaagccgcctgattccgtccaggcttgcggattacgcagagcgccatgatgaggcggcatttgagaaagagttcggtgtagaatgtatggagtgtggttcctgtagttatgtctgtccggcgaagcggcagcttaagcaggcgatcagttccatgagaaaaaccgttcttgcaaacaggaagaaaaagtagaaagtgagaggtggacaaagtgaacgagcagtttaatatttcggcatctccgcatatccgggccaaggactccacaggaaatatcatgctgtgggttgtgattgcgcttctgcctgcgacgctttttggaatttggaatttccgggatcaaaatgcgtggattttggtgatcgtgacagtggcagcggctgtgctgacggagtttgtttacgaaaaactgatgcataaaaaggtgacgattcaggatatgagtgccgcagtgacggggcttttgctggcgctcaatcttccgccttctgccccatggtggatgggcgttttgggagcagtgttcgcaattctgatcgtaaaacagctttttggaggtctgggacagaattttatgaacccggcccttgcggcaagatgctttcttttgatttcctttaccgggagaatgacctcttttacatacgatggtgtggctggggcgactcctctggctacgatgcgcgcggatggttcgattgcgaatgtagatactatgaaaatgtttattgggcagattccgggaacgatcggggaaacttccgtgatcgcaattatgatcggtgcaattatcctgcttttaaagggaattattgatcttagaattccgggcagttacttggtaagctttgtggtatttatcacgattttcggtggtcatggttttgattggagctttattaccgctcatctgtgcggcggtggaattatgctcggcgcctggtttatggcgactgattatgtcacaagcccgattactaagaaagggcagatcgtttatggtatccttcttggtgtcctgaccggactgttccgcctttatgggggatccgcggagggagtatcctacgcgattattatcggcaacattctcgttccgctgattgagaaggttactcttccaaaaccatttggtaaaggaggagagaaataatgaacaagattttgaaaaatacggtgattctgacaatcatcacactggtttccggcgtggcgttaggcggcgtctatcagattacaaaggagccgatcgcaaaggcacaggaagaggcgaagcaggaggcgtatcagcaggtatttgaagatgcggatgcttttgaagtgttaaaagtggatgcccaggaagctgcggatgcggttgcgtcagcaggtgtggacgacggcgctgtcattgatgaggcagtagaagcaatacagggcggcgaaacgattggatatgttatcacatccactgacccgaacggatacggaggggatatccaggtgtctgtcggtattcaaagcgatggaactgtcagcgggattgcgatcctttccatcagtgagaccgcaggtcttggtatgaaggcggcggaaccggatttttacgagcagtattccggcaaacagacagatcacttttacgtctctaaagatggaggagagggcgaagagatcgatgcgatcagcggcgctactatcacaagcagggccgtgacaggagctgtgaactcgtctcttggatattttcagaatgtattaggaggcagtgcagatgaatagatgtgtggaacgcttatataatggaattatcaaagagaatccgacgtttgttatgatgcttggcatgtgtccgacgcttgcggtcacgacatccgccatcaacggaatcgggatgggactttccacaacggtggtgcttgttttatccaatattatgatttccgcgcttcggaaaatcattccggattcggttcgaattccggcatttattgtagtggttgcttctttcgtaacgattgttcagtttcttctacaagggtttgtaccgagcctttatgattcgcttgggctttacattccgctgattgttgtaaactgtatcatccttgggcgtgcggagagttacgcttctaagaatccgatccttccgtctttgtttgacggacttggaatgggacttggatttacctttggacttacctgtattggtatcgtaagagagctgcttggagctgggcaagtgtttggtattcagatcatgccgtcttcttacgagccgattacgatctttattttggcgccgggtgcgtttatcgtgttgtccatgctggtggcggcgagaaacaagattatgaatcacatggaaaaaaagggcaagaaagtcgtaaagcctcaaggtggctgtgcggaaggcggatgtgcttcctgcggtggatgtgcttcttccctttcatccggacaggacaaggaataggagggggaacagatgaaagaattatttatcattgccgttggctctgcgcttgtcaataatgtcgtgctgagccagttccttggaatctgcccgttccttggagtatctaagaagattgagacagcggccggtatgggtggagcggttatttttgtcatcacaatcgcttctttttgcacgagtttgatttatgaatttattttgcagccgtttcatgtcgaatatttgcagacgatcgtgttcattctcgtgattgctgctctggtgcagtttgtagagatgttcttaaagaagacgatgcagggactgtaccaggccctcggcgtgtatcttccgttgattacgacaaactgtgccgtacttggtgtggcgttgaataatgtgcagtatgagtacaatattctgagcagcgtggtgaacggctttgcgacagcggttggctttacgatcgccatcgttattatggcgggaatccgggaaaagacagagcacaatgatgtgccggaatctttccggggaacaccgattgttctgcttacagcggcgctgatgtccattgcgttttttggattttcaggtttgatttaagggaggaaatggaatatgacaggtatactcgttgccgccgcgattgtcggtggtgtaggtttgtttatcggtgtcttccttggagtatcgcaaaagcagttcgcagtggaagtagatgagagagaagaggctatcacaggcgtgcttccgggcaacaactgtggaggctgtggatatgcgggctgctcgggtcttgcggcggcgattgtgaagggagaagctccggtcaacgcctgtccggtaggaggagctccggttgccgcaaaggtaggagcaatcatgggacaggaagccggtgagactgttcacatgaccgcatttgtaaaatgtgcgggtacatgtgaaaaggcaaaagaaaactataaatatacaggtacgaaggactgtgtcatggtgaatatgatgcagaacggaggaccgaaggcatgtacattcggatgtctcggagagggaagctgcgtggcggcatgtccgtttgacgcgattcatatccaggatgggattgcggtggttgacaaggatgcatgtaaagcttgtggaaaatgtgtggcggcgtgcccaagacatctgattgaacttgtaccgtatgatcagaagcatcttgtacagtgcagctctctcgacaagggaaaagacgtgatgagcgtatgttctgtcggctgtatcggatgtaagatgtgtgaaagagtctgtgagtttgacgcggtaactgtgacaaataatgtggcgcatattgatccggagaaatgtacgaactgtggaaaatgcgcggagaaatgtccgaagaagatcatcagttaagaagacaggatgagaaaaggcgggcaggaagaggagaatgatggacagaaagaaatggataaaagagagtatgaggatgatcaggagggatctttggagtatccggtatgtcatcttggtgctgggaatctatttttttcttgcgtggaatatattctactcttcctgcccgtttgttatgattacgggatttccctgtccgggatgtgggctttcaagggcgggcttttctattctgaggggagagtttctgcaggcatggtacctgcatccgtttatctatggaattggtttattgacggcagtttttgtgatccggagatatattctgcacaaagagacgggatctttaaagaaatggctgatctttcttttggcaggaatgtttgtgttttatatctacaggatgatccgttactttccgggagaaccgccaatgagctattatccggggaatcttctgagccggattgctcaggcgtttcaagtgctgaataggtagagaggatgtatattctgtgaaatcggggcgcgacatattgtgttgataaaaaaagcgtgataaaataaagcgagcgaaaggggaagtcaaagtcatggaagaaaataaaaatcaacttgagaatacagatcatgggatgaaggaaaacagcgtggcgccggagacaccgttccatgaatcagaaccaggagagaggggatcaagggaggatacttcgtattcttatggtgagtatcgtagagaaggagcgccatatcaggcacaggaccatggatcacagggagagtgggacagtacaccgcttacgatgggcgattggctgttgacacttttggcggcctttattccatgttgtgggggcattattctctattgttactgggcttttgccaaacagggaaatcttcaccggagaaatttctgccgtgcggctctgattattgaggcagtactggttgtacttctgattgtgttcctgattcttgttgtcatgatcggaagcgtttcttacggaacgacatccggaggatattattacggatattaaaatgataaaagtaaaacggcggagcggtctttcaaagcagcaccgtcgttttcgtttgtctgccgcaggagtcgaacgtacggttgcagtgccgaggaggatgtgctaaaatagaccggaagaaggaggggccgatgaaaaaaggggatatcatacttgttcttgtgattctgcttgtggcaggatcggcgtttggaatatatacgttcctctccgggcatgatggcggcgctgttgtcatttatgtggacggggaggaagaagggcgttaccgcctggataaagaccgaaccgtggagataaacggcggaacgaatacacttcgcattgaagatggaagcgcccggatggaaacagcccgctgtccggatcagatttgtgtccggcacaaggcgatttcgcgaaacggagagaatattatctgtctgccttacaagatcgtggtgtcgatcgaagaaggggaggatacggatgtggatgcagtagtacagtagatgaggtgaaacgtggagagaaaaggagcaaggctggcgtcatttggagtttttgtggcgcttgcattgattttcagttatattgagaccctaatcccatttcagatcgggattccgggggtgaagcttgggcttgccaatctggtcattgtgattgccctttaccggatgcctgtgggagaggtgtacttgctttctggagtgcgtgttgttctgaccggatttctgtttggtaatctgatgagtattctttacagtctggcaggaggtattctcagtttgacggttatgtgggggatgaaacggatccgttccgtcagtattctgggcgtgagcattgcgggaggggtattccacaatatagggcagcttttggcggcggcgttgatggtggagacatatggtgtcttttcgtatttgcctgtactgctgatctccggacttttgaccggatttgtcatcgggttagcggccggtgagatgctcaaaagaatccggtcactgcaattttaacaggatggaggaaatgacatgatttcatatattcgtggggagcttgcggatgtgagagaagaccaggtggtaattgacgttgggggagtcggctatgggatttttatgtccggcagtgatatagcaagacttccgtccacgggtcaggaagtgaagataaatacatatctacatgtgaaagaggatgtaatgcagctttttgggtttctgaccagagacggactggaggtctttcgcctgattatcggtgtcagcgggatcggaccgaaaggcgggctgaatatcctgaatcagatgacacccaatgaccttcggtttgctgtgttggcaggagatgtaaaggctatttccaaagctcaggggatagggaaaaagacggcagaaaagctgattctggagctgaaagacaaactggagcttaccgaggctggtggaaatgagccggagggaaagacgcttttgcagaagtcggcgggaaccggagagattcagggagaagcagtggaagctttggtggcacttggatatggaagtactgaggcattccaggcagtcagaagcgtcgaaatcgacggagacagtacggtggaggaggtgcttaaaaaggcactccgccagatgtcgctgttttagcggtacggctttaaagatcgtcaccggaacatggtaacgattcggccatatggtcagaaaacgagattgtggaaggcaatgagacaatgaagaaacgaattattacaacagaaactttggaggaagaccagaagattgagggaagtctgcgtccgcagtatctggaggattatatcggacagacaaaggcgaaggagacgctgaaaatttatatcgaggcggctaaggccaggggagaggcgcttgaccatgtgctcttttacgggcctccgggacttggaaagacgactcttgcgggtattatcgccaatgagctgggagttaatatgaaggtgacgtccggtccggccatcgaaaagccgggggagatggcggcaattctgaacaatttacaggaacgggacgtcctgtttgtggatgagatccacaggctgaaccgccaggtggaggaagtgctctacccggcgatggaggactatgctatcgatatcgtcattggcaagggagctggagccaggtcgatccgcctggatttgccgaagtttacgctggtgggagcgacgaccagagccgggatgctgaccgcgcctctgcgagaccgttttggtgtggtgaaccggctggaattttatacgacggaggagctgcgaacgattgtacagcgctcggcacagatgctcggtgtggagattgatccgaaaggggcgatggagatcgcaagacgttccagagggacgcccagacttgcgaaccgtcttttgaagcgggtgcgggattttgcccaggtgaaatacgacggggtgattacagaagaggtggcggtctatgccctggatcttttggaggtggaccgtttcggactggattatgcggaccggacgattctgatgacgatgatcgagaagtttggcggcggcccggtggggcttgagacgttggcagcggctatcggggaagattccggaacgctggaggacgtctatgagcctttccttttaaaaaacggttttttgcagagaacaccaaaaggaagggtggctacttcgtttgcctaccagcatctgggattttcactttctagggacagttaaaataacgattcaggccgtacggcaggacagcgatggaatcgttacgaatctcgtagaaaaaggttggtttttctgacgggatcgtttataataattatcagagacttcgttttagaaggaggaggcactggctatggcagcatcaagaaattataccgaagttatcattgatggcaaggtatttacgctgagtggttttgagagcgaggagtatctccagaaagtatccaactatctgaatcacaagatagcagaatgtagtgagaacgagagctataaaaagcagagcagcgacacgaaaagcatccttctcgcactgaacattgcggacgattatttcaaagcaaaagagcagggcacgtctcttgaaattgatatggagtcgaaagataaagagatgtatgacttaaagcacgaattgatctccgcacagattaagctggaaaatgcggacagggcaatggagaagatgaaagaggaaaaccaggaactgcagatgaagattgtgcagttggaaacggaaatgaaaaatcaccgaaagaattagggctgtcgaaggacagccttttttcaaagtaaggcaggaatcaagagtcatggagaatagaaaaaagagaagagaagtggagattctggcgccggcggggacatacgaggcgtttgaggcggcgatccggtccggagccgatgcggtgtacgcgggcggtaatctgttcggagccagggcatatgcgggcaattttgatgaggaaacgatgatccgggccatccgggaggcacatctgtacgggagaaagctgtatctgacagtcaatactctgattaaggaacgtgagatgaaagaaaggctgttttcgtttctaaagccgttttatgaaaatggattggatgcggttctcgtccaggatctgggggcgcttgcatttatacgggagcagtttccggatcttgcaatccatgcaagcacgcaaatgtccgtggcgggagcattaggagccggatttttaaagcaatatggcgtggagcgggttgttccggccagagagctttcccttgcggaaattagaaagatgaaagaggaaacgggactggaaatagagtgttttgtccaaggggcgctttgttactcctattccgggcagtgtctttttagcagtatgctgggaggacgtagtgggaaccggggacagtgtgctcagccgtgccgtctgaaatatcaggcagaagggcaaaaaaagccttcctgtatcctgagtctcaaagatatcatggcattggaggatcttccggatctcatcgaggcaggggtagattcctttaagatcgagggcaggatgaagaagccggaatacgtttcagagacggtacgggtgtatcggaagtatacggatctttatctgaaaaagggaagagccggataccaggtatctgaggaggataagcagcgcctgatggatctttacaaccggggcggtagctgccggggatattatcatgtacagaacgggccggagatgctgacgccggacaggtcgaaccatgccgggatccactctgcctgcgtggagcgtcagaaaggccgaagccttcttgcaaaggcacttgtaccgctccagaaaggggacgtgctggaaatctctccaaaggaaaatgtcacccttggacaggatgtaaaaaagggcgggcagtttcagctccttgtggcaaaaggaactacagtccggccacgcacgattctggcaagagtacggaatgaacgattgatccaagagattcaggagcggatccggacggccgaggtccgacgtccggttcaggcaaaagcaatgttctgtatggacgagccatccaaactgatattgaaaagcggttcattttcggtacgtgtagaaggaagttctccgcaagctgcaaagaagcaggcggtagaccgggcaagagtggaaagacagcttcggaagatggggaatacgccgtttcagatcgagtctctggagatggagatggaggacggtatttttattccaatgcaggtagtcaatgagctgcggagaacggctgccgagcgtcttgaggaagaaattctgaaacagtataaacggtcgtgcaagagggtaccgatggtagaacaggaagagattcaaggtgagtctttgatctccagggagggacaaaaaaacgtgctttctgtactggtggagacgaaaaaccagctccgggtggccgcacgatccgaagatgtgaggcgaatttatgtagaaagccatctggcggctgctatgtgttccaatcaggaggaaagagaagagatccaaaggctctatgaagagagtaagattccgtggtacattgttttgccgcacattttccgcgagcgggcgaagcgcctgcttgacagcagatggaaggcaatttgtgaggttccgtggaagggggctcttgtaagaaacgtggagtctttggcatatttgcaaaaaaaaggctggaaaaacacggttcgtgcggaccatcatttgtatacattgaacaaaaaagcagtagaattcttgaaaaaggcggggataaatggtacaacaatatcattagagttaaatagtcaggagattcgtgagatatgtaccccggcatcggagatggtggtatatggctacgcaccgatgatgatcagtgcggggtgtgtaaaaaagtccatcggacgctgtgatggtaaagagagcatcacgagactcaaagaccgctatcagaagacattttatgtaaaaaattattgtgatacatgttataatattatctataatacggcgccgcttgttttgttggaacagataggggagatcgaagagatgggaattcacgagatccggcttcattttacgatagaggatacagaagagacaaaaagggtgatccggatttacgcagatgcattctggaggggacagaaaactcttacggcagcagaggtatttgctgattttacaagaggacactataaaaggggaataaagtaggtgacaagttgtttaatatcataatggaaatttcaaaatatctgattctgctgatgatggtaatctacacgtttgagtgtttcagtgtgttcggttatcacgatgcctacacgaagatgtggatcttacgaaggcagagcatctggatctttatgatccattttctagcgtttctgacgttgtttttacggatgaaggaggccaggattctagtattttatgtgatacaggtggcgcttttgggatcgattatcctgctttatggttttttgtatccgaaagtatcaagacttgttgtcaacaatatgtgtatgcttttggcagtcgggtttatcatgctgacaaggttatcttacagtaacgccgtcaagcaggcgttgattgtagcggtatcggcggtattatcattgttcgtaccggtcattatccgtaaggcacggtttctctcccggttaaagattttctatgcggtggccggagtggtggcgcttgtggcagttattatcgtcgggcgtgtgtcatacggtgccatgcttggatttgaggttgggggaatcagtattcagccatctgagcttgtgaagattatttttgtattttttgtggcggccagcctctatagaatcagggattttcgcaatgttgtcatcacgactgcgattgctgctctgcacgttttgattcttgttgcctccaaggatctgggggcggcgctgattgtctttgtcgtgtaccttgtgatgttgtatgtggctacgagacagccggtctatattgcggcaggcttaggggcagggagtcttgcttcggtagccgcgtattttctgttttctcatgtgagaacgagagtaacggtctggaaagatccgtttgctgtttacagcaatgggggatatcaggtggcgcagtcgctgtttgcgatcggtaccggaggctggttcggacttggactttgccagggacttccggataagatcccggtggtcacgacggactttatcttttctgctatagcagaagagctgggagctgtctttgcgatctgcatcattttgatctgtgtcagttgttacatcatgtttctgaatattgcaatgcagatcagagacagcttctacaagctggtagcgctgggacttggaacctgttatattttccaggtgtttctcgcgatcggaggcgtcattaagttcatcccatccacgggtgtaacgcttccgcttgtgagctatggaggaagttcccttttaagtacgatgatcatgtttgcgatcatccaggggctgtatatattaagagaagatgaggaagaagatattgagcgacagaaagagagacaattacgggcaaagagaagacgacaggcgcagcaggccggaggacctcgatcaaatggaacaaggtcttcagcgggagcttcgtcgggagatcgaagaagaaagcctaagagccggggatcacagcgtgtaccaagaccgtagaccggttccgcacaagccgggaaaagcacaaaagaaaaaggagaagcaggaagaacgccgccgggacaagagaaagaagaaagccaaccgacagtatgtctttgtgacttactttttcgtactgttattcgtagggatgatcggatatttctcttatttcaatgtggtaaagggcagggatatcatcaatgattccaggaatccgagaatgagtctttatgaaaatcaggtgctgcgtggctcgattttggataaggatggaaacgttcttgcaaagtccagggaaaatgaggacggtactcagacaagggaatacccgtatgagcagttgtacgcccatgtggtcgggtacgcagataaaggaaaatcgggcctggaatctgcacagaacttccagcttcagacttcggatgttccgctgcagacgaaattgctgaatgagctcagaggccgaaaaagtgaaggaaataatattactaccacgctggatacgaatattcagcaggcggcgtatgatgctttaggatccaacagaggtgcggcggtggtaatcgagccgagcacgggaaagattctggcgatggtttctaagccatcctataatccgaacacgattgtggaagactgggagagcctgaaccagaatacagaggggattttggtgaaccgtgccacgcagggccagtatgcaccgggatctactttcaaggtactgacaacgttggcatatatgcgccagaatccggattacaaaaactacacgtatcgttgtaccggagagatcacagccgggaaaaatgagattcactgctatggaaatgaggtacatggaacagtggatctggcagaatccctggcatactcctgtaatacttctttttccaacataggtctcagtttggatgtggatgagttccgaaagacagcagaggatcttttgtttgacacggaattgccttgcccgcttatttataatgagagtaagttcaatcttaagaaggatgacggagatgcagccattgccatgacggcattcggacagggaaaattgcaggtcagtccatattatatggcaatgctgacttcctcgatcgcaaataatgggattttgatgaagccttatctggttgatcagattacgagtgcccagggagagacagtagagaaatacgtgccggaatcttataaggaactgatgacttccgaagaggcggcacagcttaccgaatatatggagggtgttgtagagtacggtacagcccgttccttacattctcttggtgtttctattgccggaaagaccggaacgagtgaatacagtgatgataaagagaaaacgcactcctggtttatcggattttctaatgtagagaatccggatgtagcattggcagttgtcattgagaattcagacagtaccggagacgtagcgacagacattgccgaggagatttttaaggcgtattatgcaaaatagaggttctgaaaatgaggtattggaaagaactgtatgtcagtgaagagctaaaaggcagggaagaggagatcatcgagcatctggaaaagaaagaattccagttcagggtctatctgatcgccctgccggaaaatgaaagaaatcaactggaaatataccatagcgggatgctgaatcaaacgtggtacagggaaaaagatgtatttgtggtaggtctggccaaaggatatctacaggcactggagcttgtcaaggagcttatcgatcaagtgttccgggagaccggggatgcagatgtcaggcagtatatttggaagcggcagggaagttagaatgatcattgtacatattttactatggattctaaagatagcaggcatattgcttctacttgttttggggctgcttttgcttggaatattgattctgctgtttgtgcctgtgcggtacgaactaagtgccgagggagatattcatactccggaagagatccgggtaagcgtttccatccggtatttctttcggctgatcacctttcacaccgtctatgaaaaccagaagttttggcggcaggtgagaattgcatggaagaagatcgggcaggataaagaagagaagcaagaaaccgaagaacaggagaatccgaaaccggagaaagaaatttccggcaagatggatttagaacgggaggagaaagagagcccggaagaagtaagagcgattcgcagtgaaaacaaagatccggaaaaagaggacaaggtgcgaagagagaaaccagaggtgaagcgtcctgtatccggcgaagcggggaaaaaggaaagtaaggcaaaggaagaaagtgaaaagaagaaagaaacaaaagcgactgtttttgagcggtttctcgagaaaatcaagtatacatttcacaggatctgtgataagataaaggcactgtccgatatcaagaaccgggtggagacggttatcaaagatgaagtacaccaggcggcgttcagaaaaggaaaagaaaccgtatttcgtcttttgaaagcatggcttccgagaagcggctggggaaggatcgagtatggacttgatgatccttattatacaggaaagattttggccggtcttgctctgttttatccattctttggacagtggcttcagattgtgcctgattttgagaagactacccttcgtgggcgggtgttcatccgggggcatatccggatgaatcatttggcaggggcggccgtcaggctggcggcagacaagaatatccgcagtacggcaaaagaggtgctgcgtctgttaaaacggcagaaaaaggaggaagtataaatgtcagagagtaatttcaaatcaacgatggaagcattgtttcacggaatggataacgtgatttcatccaagacggtggtgggcgaggcgatccacataaaagatacgatcatcctcccgcttgtggacgtgtctttttccgtaggggcaggatcgtttaccgcagagaaaaatgaaaaaggagcaggcggactgggcggaaagatgacgccgtgcgcggtgcttgtgatccagaatgggacaacaaggctggtaaacattaaaaatcaggatacgatcacaaagattcttgacatggttccagatctggtagaccgtttccgcaccaaagaagagacgaaggtgacagaagaagacgtcaacgagattctggatgaagggaaaaagcaggacgaataaagagaagaaaaaatgcatatataagaacaaagaagaaaacggcagggatatcgtatgagaagagtagtaggatttgcgtgttttatgatcgcggcaggactgattctttcgatgttcctgccgggtttggtttgggatatctttatcacggcagtgtttctggtgttgggatatgtgttattctgctgttaaataggaaacaaaaaaaccaggacgatcgatcctggttcttgtgtatgcagaacttatgctctttctactttgccggattttaaacaggatgtacatacatacattctctttgctccgccttctgttttaacacgaacagattttacattagatttccacatttttggtgtttttctatgagagtggctgacattgtttccaaaatgagcccctttttcgcaaatagcacatttcgccatgattacacctcctaacgctcttactagtcctcatataagagaactcacaacactaactatattatcagatatattctggaaatgcaagagtttatttccgggaaatgagaaaaatttcattgttttagggataacatgaagagtatatgttgtaaaatatgcgtaaacaaggtataataaaacagaatacttcgtggaaagaacggaaatcaaggatagataggaattggaggtatcagagtatgaaaggcagcatgagtacagaactgggaattatcaccatttcaccggaagtgattgcgaaatatgcaggatctgttgctgtggagtgtttcggtatcgtcggaatggcggcagtcaatatgaaagacggattggtgagactgctgaaaaaagacagcctgacccacggcatccatgtggagctcacggaagataacaggattcaccttgacttccatgtcattgttgcatatggggtcagcatttcagctgttacggacaatctgatcagtaatgtaaaatataaagtcgaggaattttccaatatgccggttgataagatcaatgtctacattgaaggcgtacgggtaatcgattaatatgggaggaactttgaggtggctatgaaaacgataaatgcagacatgcttgcgaagatgtttttggcaggcgcacagaatatagaggctaagaaagagtacattaacgagttgaatgtatttcctgtcccggacggagataccggtacgaatatgtccatgacgatcatgtcggcagcaaaggaagtaagagccctggaacatccggggatgaaggagctctccaaggcgatttccagtggatccctccgtggcgccagaggaaattccggcgtgattctttcccagcttctaagaggatttacaaagtcgattcaggaagagacggagattgacgcggccggtattgcggcagcctgcatgcgggcgaaggagacggcctacaaggcggttatgaagccaaaagaagggacgatccttaccgtggcaagagggattgccgagaaagcagaagagcttgcctttgagacagaagatctggaggaaatctttccgaagattctggatcacgcacagcaagtgctcgagcagaccccggagttgcttccggtgctgaaagaggcgggggttgtggattccggcggacagggacttctggagattttaagaggtgcgtatgatgcgtttcttgggaaggagatcgattattcttctatcgaaccatccaaggagccaaagacatcctttgggaaggcaccgatggaggagaccgacattaagttcggctactgtacggagtttatcatccttaccggaagagagttctccgatcaggaggagcaggagtttaaagcgtatctggaatccatcggtgattcgattgtctgtgtggcggacgacgaggtagtgaaagttcatgttcacacgaatgatccgggtcttgcgattcagaaagcgctgagttttggacagctcacaaggatgaagatcgacaacatgcgggaggagcaccatgagagagtcattcaggaggcagagaagcttgccgctcaggaaaaacggcagaagccgcaggagaagaaacgaaccggcttcattgtcgtttctatcggagagggaatgaatgagattttccgggagatcggagtggattatattattgagggcggccagacgatgaatccaagtacggatgatatgttacaggccattgatgaagtgaatgcggagacgattttcattctgccgaataataaaaatattattcttgcggccaaccaggccagggatctgacaaaggataagaagattgttgtcattccgaccaaaacggtgccgcagggaattacggcagtcatcagcttctcttcggacgaggatacggctgcaaatgaagctgcgatgacagaagcgattcaggcggtgagaaccgggcaggttacctatgcagtgcgcgatacgaagatcggggacaaggagattcacgaaggggatatcatgggaatcggcgacgagggaattctcgctgtgggaacagatatttccgatacggcgaaggacctgcttgcaaatcttgtgacagaagaatccgagcttatcagtatttactatggcgaggatatttccgtggaagaggcagagagatttgtgacttccgtggaggagacatatccagatctggatgtggatgctcactgtggaggacagccgatttactactatgttatgtcagtagaatagagaaagagaggaaagggatacttaaaaggtatccttttcccatgtgaagaggtataaaatatggatgaagattccagcattagagagatcaagggtattggagaaaagacggaagcgctctttcagaaattgggagtaaatacggcgggagatcttctgcgtttttatccgagggcctatgatatctatgaggatccggtaacggtcagtgagctggaggaaggtacggtagctgctgtggaaggctgtgtttacggaaatatccaggtgtcgccgaaccggaaacttcagacgacgaccgccatgatcaaagatgtgaccggaacactgaaagtgttgtggtttcggatgccgtttttgcgtaatacattgcgctccggaagccatatcattgtaaggggccgggtggtaagcaggcgaggttctcttgtgatggagcatccggagatttttcagccggcaggcaaatatcaggaaaagcttcatacgatgcagccggtgtacccgcttactgccggactgtcgaatctgactgtgagcaaggctgtgcgggaagtgatggagcatgtacatctgcagaaggagacgttgccggaaagtatccgtcagatctttgaactctgcgaatacaattatgctctgaaagggattcatttcccaacggataaaacgatgtatatgcaggcaaggaaacggcttgtctttgaggaatttctggaatttattctggcggtccgccagatgaaagaggagaaagaagcaagcgtcaattggtgtcggatgaagccggcaaaagaagtggatgatttccttggcagacttccgtatgagctgaccaatgcacagaaaaaagtatggatggaaatccgaaaggatctacagagcgatgatacgatgtccaggctgattcagggggatgtgggctcaggtaagacaatcgtagccgttttggcgcttctggaggcggcttataatggatatcagggagcgatgatggcgccgacagaggtgcttgcaagacagcattaccagtctgtctgtgacatgtttgagaaatacggcgtcgggttccgggcagagctgctgacaggttccatgaaggcaaaggagagaagggaggcttacgcaaggattgagagtggggaggcagatgtggtgatcgggactcatgcattgattcaggataaggttcagtatcacaatctgggattggttatcaccgacgaacaacatcgtttcggagtgcggcaacgggaagcactggcaaaaaagggaaggatgccacatattcttgttatgagcgcaacgccgattcctcgcactctggccattattatttacggagatctggatctttctgtgatcgacgagctccccaaggaccgcctgccggttaaaaactgtgtggtggataccgggtatcgggagactgcatatcggtttatgaaaaatcaggtggcagagggcagacaatgctacgtgatctgcccgatggtagaggaaagcgaagcaatggaggcggaaaacgtcatggattactctaccatgctttccgagaagctagggacagggatcacggttggatacctccacgggaaaatgaagcagcagcaaaaggatgagatcatgcagcggtttgcggataatcagattcagattcttgtttcgacgactgttgtggaggttggaattaatgttccaaacgctacggtgatgatggtggaaaatgccgaacggtttggacttgcacagcttcatcagctccgggggcgcgtgggaaggggagcgtttcagtcctactgtatttttatgacaggatccaaaacgaaagagacgaaaaagcggctggatattctcaatcattccaacgatggattttatattgcgggcgaggatctaaagctgagagggcctggagaccttttcggcatccgtcagagcggacttatggagttcaggcttggcgatgtcttccaggatgcaaaaatcctgcagatggcggcggaagcggcaacaatgaaagaagtacgggaatctccggtatttacaagagcaaaccaggatcatattcatgtactgtaaggaagcggtttatctgatggtaatcttctatggttgtttttagtcaatgaaaccgtatagaaaaaggatatggtgatacctatttcatacccgccatatccttaaaaagaaaaacaccgcaatctccgggaatactgggaatcccttgaaattgcggtacttttttgataagccgaaaatcagactcgaactgacgaccccttcattacgagtgaagtgctctaccgactgagctatttcggcttgtgctgtacgatgtccctacacgatgtctttccaacaggcacaagtattattatatacatttttaaaaaatttgcaactgtttttttcatttttttatatgaggtaaagatttaactgcgtaagcagcaaaaaagtagcataaactgcgaatttaagtcgtatggctgaatctttatcattttagcgctttcgtttacacggtttcattaaagacgaagataacgatgaaaaagagcatccctatttccttttatgaaaacggggatgccctttttggcgtttcacattcttttgttcagaaagagttatttaccagccatctgtctttcctgttcttcgatcatcttcttgaccatataaccgccgacagatccgttctgtctggaagtcaggtctccattgtatccgtctgttaacggaacaccaagctcacttgctacctcatatttgaatttgtctaaagcaccttttgcttctggtacggctgctttattagatgaacgatttgtcatgctaatgtcctcctttatcgtcgtgtggttttgtgtaactttttgttacagtcatagtatatgaacatttgtataaattactctgggaaaaacaggaaaatcctattgacaaaaaaacaggtttttaactacaatttttctggaatgtttttttgaaaaaagaggaggcagtatatgagagaaatggaatttaaaatggaaaggtccggattgattgaagaggggcaggaagcagaagtaacagaacttcaggcacttggaggatatagttatctgattgagccatctgtggcaatgagtgggctttacaaaagctgggatcgtttaaaatccagaaaaggcatcataaaagaaattaaagaaacagaccggggattttatgttacaatggagtttgacgaataaagccggatgtagagtctgacatggaaaaatctggatagatgaaaagtcattttgacagtagtaggcctgtatgataagatagggcgtgaaaggaaccgagagtataaaggaaaggaatggacataaagatgaggagaaagatacataggttttgtggtattgcactcagcgcttgcctgttgcttggagcctgcatcactccggcgctgacaggagatgcagcggacaagctttcaggtaatgtggcagaggaaacgacagcaacacggaatgagaaggtttcaaggaatgatttggagcctgcttcagagacagatcttttatctgaggaaaccggggacaaaacaggggagctgaccggacaagaggaggcgggatcgaccccgaaggacggaaagactacaccggagactgagacaaaagacgatcctgttgtcaatgagggagaaaccgatgataatgagacagtagaagacgaagatattactaaggcttcggaagaagagaccgagccggaggagttaaaggagaacagtttccgttatcagaacggagaactgatttccgagccgcaggtactttcaagagcatcctatccatatgcgtggcagaaggtgaatgggaagtatatgaacagcatcggtcaggtaattgaaggggcgacgaagaaaggaatcgatgtcagccatcaccagggcgttattgactgggaaaaagtgaaaaaagatgggattgactttgcaatcatccgctgtggttatggcggggattatcagtcctatgatgataggtactggataagaaatgtgacagaatgtgaacgacttggaattccatatggagtgtatctctattcttattctgaaaatatagaagatgccaaaagtgaagcggcccatgcgctgcggcttttaaaggggcataaaccggcgtatggaatttactatgatctggaagatgaaaatacgacaggaagagtgagcaatacaactatcggtaccattgccaaaactttttgcgatcagttatcgtcagcaggctacaaagttggtatttatgccagcaaatattggtggacagaaagactaacctcctctgtatttaagaatgaaaaatggtctaaatgggtagctcagtataacacatcctgtacttatgaaggaagttacgatatctggcagtgtacttctacaggaagtgtcgcgggaatcaatggagcggtcgatctaaatttctggatgggagatccgcaaaattctaatacaagtacttctatagacagaaatatcatttcaagtgcagggcatgtgcagactgacggttggaccgcgtccgtacagaacggtgatcagattggtgtaacaggacaatctaagcgactcgaagcgttccagattaagattggaaacggttatggagatctggggatccgatacgcttcttttgtggaagatcaaggatggcaagcttatgtgacgagtggaaaaacgtccgggacgaccggagagagcaaggcggttcaggcagtcaaaattcaactgactggttcaaaagcatcaaattatgatgtttattatcgtgcccatgttcagacgtacggctggcttggttggacaaaaaacggagcagcagcagggacgacaggttatgaaaaaagaatggaagcactgcaagttatgattcttccaaaaggagcggcagctccgggggccttatcaaatgcatataaggaaaaagcattgacgaaaggaattggctatgaagcccatatgcagacatattgttggctgggtgaagtagcaaacggagcgaccggaggtatcacgggtcagtccaaacggatggaggcattgcaaattaacctgaaatatccgcagtatagtggcgatgtttcttatcgtgcttatgttcagaatacaggatggcagggctgggtgaaaaatggtgctactgccggtactaccggaaaaaatcttcaaatggaagcggttcagattaaactgaccggaaagatggctgaaaagtatgacatttattatcgtgttcatacgcaaacgtacggttggcttggatggacgaaaaatggagcaagtgcgggcacaaatggatataataaaagaattgagggaattcagatccgtcttgtagcaaagggcggggcagcgcctggaagtacatctggcgcctataaagacagatccaagactaccaatgttgtatatcaggcccatatgcagacatattgctggctaggtgaagtaatgaatggtgcaaccggaggagtgaccggtcaatataaacgaatggaagctttaaaaatcagtcttgaaaacaaaaaatattcaggcggaatacagtaccgagcgcatcttcagactaccggatggcagggttggaaaagcaatggggaaatggccgggacaaccggacaaagccgtcaaatggaagctatccagatcaaattgaccggaaagatggcggaaaaatatgatatctattaccgtgctcatgttcaaacatacggttggcttggctggacaaaaaatggtgctaaggccggaacggaaggcctgagtaaacggatggaaggtattcagattcagcttgtagaaaaaggtggggcggcgccaggaagcacatccggctcatttaaagagaaagagaaacctcagaatattgtataccaggcgcatatgcaaacgtattgctggctgggtgaagtaatgaatggtgcaaccggaggagtgaccggccaatataaacggatggaagctttgaaaatcaagattcaaaatccgaaatattcaggcggagtacagtaccgcgcgcatcttcagactaccggatggcagggttggaaaagcaatggagaaatggccgggacaaccgggcagtaccgccgtatggaggcagttcagattaaattgaccggaaagatggcggaaaaatatgatatttattaccgtgctcatgtccagacgtatggatggcttggctggacgaaaaatggagccaaggccggaaccgaagggatgagcaaacggatggaaggtattcagattcagcttgtagaaaaaggaaaaccgggaccatccagcggacagacagcttttcggacgaaataagaatacacataccctcacacagttttctatttcagaactgtatgagggtatgtttgttttgcgtcaaatttcaaaatcgtttcacatacctcaaaagtgtttctgatatactttctccactactccgatcactgcatacaacgccattgccatgatacaaagcaatacgatggacatcaaaagccaatccatcttaaacacctggctggagtagatgatcagatagccgagcccttccctggcggccagaaattccccgatgataacacctacaaggcagagaccaatgttgactttcatggtactgatgattgtaggaacggcggaaggcagtaccacttttgtgaggacatgaacagaggtgccgtgaagggtatagatcagtttgattttgtttttatcggtgccgataaaacaggtgtagagcgtcataatactgccaaagatcgccacagacattccggctacaatgatggttgtgcggttggcgcccagccaaacaatgagcagcggcgccagtgcggattttgggagactgttcaaaacaacaaggtaaggctccagcaccgctgagagattcctggagaaccagagaaaaacggcggccagaatactgattccggtcaccagaagaaagcttaggatggtttcatacagcgtggcggacatgtgaggaaagatggttccgtctttcgccatcgtcaagaaacaggtgccgattttagaaggactgctgaaaatgaaagagtcaatgattccagtgtttgcagtccactcccagagaacgagaaagagaataaggacagcggcccgcagaaacagaataagctgatgttccctcctgattgttacaaggtaggcggactgggaagtggaaagatcaggatatttgatgttcatgttggttcagctccttccagatcagattgaaataggttttgaattccggagcgtttctccggagcaacggggtatcctttgtaccgtctggatatgcaaaatgcagatagactgtctttttcaagtgtgcggggcgcccggagagaacgagaatacgatctgcgagactgatggcctcggataggtcatgggtcactaaaatggcggtttttccttcccggcggataatctggccaatatcgtcgctgacatttagcctggtctgataatccaaggcagagaatggttcgtcaagcaggagtacttccggatttaaaatcagggtgcggacaagagcagccctttggcgcattcccccggataattcagacgggcgggaatccttaaattgaccaagaccgtaggcgtccaggagttcgtgggctcttttgcggacctcaggagtgagagaccgctgtatttcaggaccaatcagcacattccgatagatgttccgccattcaagcagttcgtcgcgctgtagcatatatccaattttgtccttctgttcttctacaggtttttcatgcagaagaatttctccttgttccggttttaagaggccggaaatcagagacaaaagggtggacttgccacagccggagggaccgacgatggcgaggaattctccttgatttaccgaaaaagaaatatcacatagagcaggagtttctcctttcagggtatgataggaatggctgatctggtggatattcagtattgtgtccatgttgctgacctccttccatgtataccataatgtatgttgacagagaaaaagatgtgaattataactattagtagattttaggcgaagaaggagaacgaatgagacagcagaaaatcaattatcaaaaagaactggagaaaacactggaagcgatccggagagaggagcgggttccgacacttttgcttcatagctgctgtggtccgtgcagcagttatgtgatggagtatctggcggattttttccggattactgtcttttattttaacccgaatattacggataaggaagaataccggaagcgtgccgaagagcagcgccgtctcattgaacggatgaatgaaaagctgaaatacccagtttccgttttagagggcgagtacgacgcccatacattttttgagatggcaaagggaatggagcacctgccggaaggaggagaacggtgttttcactgttatgccatgcggctggaacgcacggcagcagaggcaaagaagagaggaatggattattttacaacgacgctttccatcagtccgatgaaaaacgcccagaagctcaatgagattggaggcagtatgcaggaaacgtacggagtttcctatctgttttcggactttaaaaagaagaacggatacaagcgctccatagagctttccaaagaatatggactttaccgacaggattactgtggctgtgtgttttcaaaaagagacagaaatactgctttacaaacagaataaaatttggtaaattatgttttaatagtttaattcattaaaatcaaaaagaaacggggaagacagatggcacagttatggggaggacgcttcacaaaaaagaccgatcagatggtatatgattttaatgcctccatcggatttgacaggcgtctgtacagacaggatatagaaggaagtatggcgcatgtaaagatgctcgccaagcaaaagatattgacggaggaggagcgggaccggattctccagggactttctggaattctggcggatgtggaggatggctccttgccgattacgaaggaatatgaggatatacacagctttgtggaggcaaatctcattgacagaatcggggatgcggggaagaagctgcacacaggacgcagtcgaaacgaccaggttgcactggatatgaagctttatgtcagagaggaggtccagaagacggaagagcttttgacggatcttctaaaagtgattctgcatattatggaggaaaacctggatacgatcatgccaggattcactcatcttcagaaagcacagccgatcacactggcacatcacatgggtgcgtactatgagatgttccgaagagatcgaagccgtctggctgatatctatgaaagaatgaatgtgtgcccgcttggaagcggcgcacttgccgggacgacatacccgttggatcgcgactatacggcggagcttcttggattttcaggagcaacgctcaacagtatggattctgtatccgaccgggattatgtgattgaatatctgtccgcactttccacgattatgatgcatttaagccggttttcggaggaaattatcatctggaattccaatgaataccagtttgtggagattgacgatgcgtacagtactggcagcagtattatgccgcagaagaaaaatccggatattgcggagcttgtcagaggaaagaccgggcgtgtctacggggcgctgatgtccatgctgacaacgatgaaaggaattccgttggcgtataataaagacatgcaggaggacaaggagatggcatttgacgctatggatactgtcaatgcgtgtctgccgctttttacagggatgctgggaacgatgaagtttcaaatatccgtgatggagcgaagcgcaaagcgcggttttacgaatgcgacggatgcggcagattatctggtgaatcatggcgtaccgttccgggacgcacatggaattgtcggccgtctggtattgacctgtattgagaaagaatgtgccctggatgatctgacactggacgaatatcaggcgatcagtccggtgtttgaagaggatatttatgaagcaatcagcatgaagacctgtgtggaaaagcgtctgacgaaaggagcgccgggaaaaggcgccatgctggaggcaatcgcgatatacaaaaaggaactgggatgtgagtaggaggacagagcatggaaaagaaattgcgtgttggaattttaggagcgaccgggatggtgggacagagatttatttctctgctggaagatcatccatggtttgaggtcgtgacagtggcagcatcgccgcgatccgccggaaagacatacgaggaggcggtaggggatcgctggaaaatgaaaaaaccgatgccggaaggtgtgaaaaagctgattatacataatgtcaacgaagtagaagaagtggcttccaccgtagactttgtattcagtgcggttgatatgacgaaagaggagatccgtttgattgaggatgcctatgcaaagacggagacgccagttgtttcaaataatagtgctcaccgctggacaccggacgtaccgatggtgattccggaagtcaatccggagcattttgaagtgattgaagcgcagaagaagagacttcatacgacccgtggttttgtagcagtcaagccgaattgttcgatccagagttatgcaccggtcctgacggcgtggatggagttcgagccgacagaagttgtggcgacgacgtatcaggcgatctccggagcaggcaagacgtttcaggactggccggagatggtggaaaatattatcccttatatcggcggcgaggaggagaagagtgagcaggagccgcttcggatctggggtaaggtgtgtgacggaaagattgagaaagcatcttcaccggtgattacgacacagtgtatccgtgtcccggtactggacggacatacggcggctgtttttgtcaactttaagaaaaagccgaagaaagaacagctcattgaaaagttgagagattaccggggacttccgcaagagctttctcttccgagcgcgccaaagcagttcattcagtacctggaggaagataatcgtcctcaggtaacattagatgtggactatgaaaacggcatgggaatttccgtaggacgccttagagaggacagtctttatgatttcaaatttgtaggtctttcccataatactgtaagaggggcggccggaggagcgattctctgtgccgagacacttgtcgcgaagaattatatccagtcaaaagaatagtggcctcagaaagaggatttacgtcagggacgggaaattttacccgtccctgattgcacgtttggacagaaccatgtaaaatagtagggacaacaggcttacagatcgtaacagttcagtcagaacgccatatacaaagtacacaataaattttcgttttcaaacaagggtgaactcagatttttgtgacttgtgcatggctgaactgttactacagatcaaatggagaaaaggaaaatggaggaatcacaaatggacggggaacttctcaagtatacacagaaccgagagctttcatggctgaaatttaatcagcgggtactggaggaggcacaagatccggatgtgcccctgttggagcggatgaaatttgtggcgatttttacgagcaacctggatgagttttttatgattcgggtcggcagtctgtacgacatggcgtccttgaaagagatggaattggacagacgctccaaaatgacgccaaaagagcagctagaacggatttacgaggcggtggagcctctttataaggagcgggataagacctactcggagattaaaaaacggctcagtccatacggtatctgcggtctttctttcaaggagcttcaggatccagagaaaaaatatgttaaaaaatacttcaaagaacagattcttccggtgctctcgccacagattgtggaccggaatcatccgtttccccatctcctgaacaaggaaatctatgtcattgcgagtctgaaacggggcaatcaaaagctcttcggactggtcccggttccgacctacctctccgaaatccttcttcttccgggacatgatatccgttatatccggatggagaagattctaatggaatatctggaaatcatttttgataaatatgaagtgtcagacaaaaattatatctgtgtgacgagaaacggggacgtctcaccggacgacgaagctcttgatatcaatgaggatttccgtaacctgatgaaaaagacactgagtaaacggaggaagatggcagtggtgcgtctggagacggcgaatcctctgacagaaaatatggagcgttatttttgcgatcggttttgcatcacgccaaagcagattttccgtacaaagatgccgatgaagttatcatacattttctctgtggcggagaaagtaccggagcacatgagacggacgctgatatatgagccgtttgtaccgcagaagtccgctatggtggatgaagagacatcgatgatccgccagatccgaaagaaagacattcttctttcctacccatatgagtctatggagccgtttttaaagctcttaaaagaagcgagtacggatccttccgtggtgacgatcaaaattacgatctatcgtttgtcaaagaaagcaagacttgtagaatatctgtgtgcggctgcggaaaacggcaaggaagtcacggttctgatcgaacttcgcgcccggtttgacgagcaaaataatattgactggtcggagcgtctggaggatgccggatgccgggtgatttatggattcgaaaactacaaggttcactcgaagatttgcctgattacctgtaagaccagaaacgggtatcagtatattacccagattgggacgggaaattacaatgaaaaaacggctgccatgtataccgacgtttgtttgatgacggcggatcgggaaatcggacaggatggggccacatttttccagaacatgtgcatgggaaatcttggcggtagttaccgtcatttgcttgtctctccgtattcactcaagaaaaaggtgctggaactgattgaggaggagaccaggaaaggggaaaacgggcggatcattatgaaaatgaattccgttacggatgtagattttattgaacagatttcaagggccagccgtgcgggtgtggaggtagatttgcttgtacgcggcatctgttgtatccgtcctggtgtggaagggtatacggatcacgtgcgtgtgacaagtattgtgggacggtttctggagcatccgagaattttttcattcggaaggggaagcgcccagaagttgtatatcggttcagccgatatgatgacgagaaatacagaaaagcgtgtggaggtgggatgcccggtctatgatgaggacctccgggcaagactgaaccacatgttacaggtgatgctggaggataatgtaaaagcaagggttctggatgctgccggaacgtatttaaaaaaggggcagggggagccgtttgtggacgcccaggaggtgtttatgcaggaggcagttcaggccgcggcggttaaaaagccggcgaaacgctcgattcgggaggtcctctttggcatctttcgcagataaaagaaggagaacaaggcaatggggaaatcgctctacatagcagagaagccgagtgtggcgcaggaatttgcaaaagcattaaaacagaacatgaagcgacgagagggatggctggaatccgacgagagcgttgtgacctggtgtgtgggtcatctggtgacgatgagttatccggaggtctatgatccgaaatataagaagtggagtctaagtacgctgccttttctgccggagacgtttctctatgaggtcattccgaatgtaaagaaacagtttgatatcgtaagcggacttttgaatcggaaagatgtggacaccatctatgtgtgtactgattccggacgggaaggagagtatatttaccgtctggtcgaacagatggctcatgtaaaaggtaagaagaggaagcgggtctggatcgactctcagacggaggaggagatcttaagaggaatccgggaggccaaggatctctcggcgtatgaccatctttccgattccgcttatctgcgagccaaggaagattatctgatgggaattaatttttcccgtattctgacactgaaatatggaaacaccatcgctggatttctgcataaaaattatgtggtgctgtcggcgggacgggtgatgacctgcgttcttggaatggtagtcagacgggaacgggaaatccgggagtttgtaaaaacgccattttaccgggtgatcggaaagtttgccgcggaccagacaaggtttgagggcgaatggaaggcagtgaaggggtcacgctatgaattctcgccaaagctctaccgggaaaatggattcaaaacgagggaagcggcacaggagctggtgaatgatctcaaaggaagtggtgggacagcaaagcttgtttctgttgagaaaaagaaagaaaagaaaaatccgcctctgctttttaatctggcggagctgcaaaatgagtgctccaagagatttaagatcagtccggatgagaccttgcggattgttcaggagctgtacgaaaagaaactggttacttatcctcgtactgacgcaagggtgctttccacagccgtggcaaaggagatccataaaaatttaaacggactttccaaatatgagcctacggcggcgcttcttggttacattgctaaagagaggacccacaaggggctggaaaaaacccgctatgtcaatgacagtcagatcacagatcactacgccatcattcctacgggacagggacttttagccctgcaggcagtatccggtacagcaaggcaggtgtacgacctgattgtgcggcggtttctttccattttttatccgccggcggtttaccagaaaatgatgcttgagttggaagtgggaggagaacatttcttctccaattttaagattctggcggaggaaggtttttacaaggtaacggggattcccggtacgaaaaagggaaaaacagacgaagaagaggagagcgttcccgactctgagctttttgatcggcttcagaagctgaaaaagggcgatttggttttggcggaggactttgagattcgggagggggagacgtcgccgccaaagcggtataactccggatccatgattcttgccatggaaaacgccggacagctcatcgaggacgaggaactccgggcacagattaagggaagtgggatcgggaccagcgccacgcgggcagagattttgaaaaaactgattcacatcaagtatctgacactgaataaaaagactcaggtaatcaccccgactttgatgggggagctgatctatgatgcggtgaatcattcgatccgctctctgttaaacccggagctgacggcgagctgggagaaggggcttacgttagtggcaaacggggagattacttcggaagagtacatgcaaaaactggaacagtttatcgccggcaggacaaacggtgttatcggactgaacaatcagtaccaactgaaggcctgctacgataaggtgtccccttattataaaacaacatatcaaacatctaaaaagtcataaggaaaaggaggagcagtatgaaagaactgacagtaacggagctttttgatctcgatgagacgattgcaggcgaaatctttgaagggattacctacccttgggaggtcctgccgaagatcggggagtttatcgtgaatctgggaaacactctgccagaggacgagtatgaaaaggcaggagaaaatatttggattgccagatctgccaaagtggcgtcgacggcatgtatcaacggaccgactatcattggaaaagatgcggaaatccggcactgtgcttttatcagagggaatgccctggtaggagagggcgctgtagtgggcaactctacagaattgaaaaacgtcattttgtttaacaaggttcaggtaccccattacaattatgtgggggactcgattcttggatataagtcccatatgggagcgggatcgattacgtccaatgtgaaatcggataagacgcttgccacggtaaatacaccagaaggaaagatggaaaccggactgaaaaaattcggcgccatgctcggagactatgtggaagtgggctgtggaagtgttctgaatccgggaaccgttgtaggaagaaacaccaatatttatcctctttccatggtgcgcggctatgtaggggcaggaagcatctacaaaaaacagggggaagttgtagagaagcagtaattgcatggggcgctgcaaatcagcaaagctgaaaaaataaggaataccgattgccggaacagaggcggttttcggaaaaggggcttgcaggttgtaagcccctttttatgctggatggatttacaaaaattttattagaagaatccatgaggacgttgtataataaatacggaaatctgctgaagtttgtggagatcgggacttcggtctgtgatagtgctgtcgtgcttctgtgcggcagagtggtcatactgttttctattcggcgtttcgcccggaatttcaaaaatgatcttgacagcaaaatgagaatcagttactattaatattataaacgaacgtttgttcgtgcgtaaaggagatcaagacatggcaaataatgaagataaaaagaaagcattggaggctgcaatagccaaattagagaaggattttggaaaagggaccgtgatgcgtcttggcgatccgaaggcgcaggttgcagtggagacggtgccgacaggagcattgagcctggatatcgcactgggacttggaggcgtgccgaagggaaggattgtggagatctacgggccggagtccagcggtaagacgacggtggcgctgcacatgatcgcagaggttcagaagagaggcggcatcgccggatttattgatgcggaacatgcattggatccggtttacgcgggcaatattggtgtggatatcgatgagctttatatttctcagcctgacagcggagaccaggcactggagatcacagagacgatggtacgctccggagcgatggacatcgtcgtgatcgactcggtagcggcgcttgtaccaaagcaggagattgagggggatatgggggacagccatgtgggattacaggcacgtctaatgtcccaggcacttagaaagctcactccggtgatcagtaagtctaactgtgtcgtgatttttatcaaccagctccgtgagaaggtaggtgtcatgttcgggaatccggagacgacaacaggtggacgcgcgctgaaattttactcctccatccgcctggatatccgccggacggagacgctcaagcagggcggagagatggtaggaaaccacgtcagagtcaaagttgtgaagaataagattgcgcctccgtttaaagaggcagagtttgatatcatgttcggtaaaggaatttccagggagggcgacgtactggatcttgcggcgggacttgatatcgtcaataagagcggtgcgtggtacgcctatgagaataataagatcggtcagggccgggagaatgcgaagagttacctaaaggagcatccggaggtgatggatgagctggaagcaaaggtacgcgcccattatggtctggatggaggaaccgggaaaacaaaggaggaagctgagggcgccggcgagaccggaaacgaagagtaaacgatgagacgagtcagaattgagccggttacgaagacccggtttcggatttatttagatggacagttcgcttttgtattatacaaaagcgagctggtttcctgtaaagtaaaagacggggaggagatctccgacgagcaggtggaagtgattctcaaaggaatcatactaaagcgtgccaagcagaaagcgctttctcttcttcagagtatggaccggacgaaaagcgagctgagggaacgccttttgcgccaggattttccggagaagatagcagatgaggctgtccgttacgtggagtcttttggatatgtggatgacagaagatatgtggagagttttattctttccaggaaaggacgtaaaagtaaacgggaaatttttgccgaactttccagaaagcaggtggatgaagccattgtggacgagatgatggagcgctgctatgatgcggaggattccggggaagcgatccgccgtttcctgaaaaagagacattatgacccagagcaggcaaccatggaggaaaagcagaaagtctacgcatatcttgcgaggaagggcttttcctaccgggagatcaaagaggtaatggatctggctgcgatggaagaatagatgcccgtaacagttcagccgaacagcggcttatctgagctgctatggctgaattgttacggtttccacgaaagaaaagagtcggtgcttgacatatttgttaaaacagtataaaatttaagtgttgtaattgtacaatgaaaattaaataaggaggtgctcctgtgcaaattttctatattatcgttgcagtcgtgattacgcttgtcattacagcggcagttacttattatgtgacggtttccaacttgaaaaagaatgcagaatccaagatcgggaatgcagagagtaaagcgagagaaatcatagatgatgcactgaaaaaagctgagacgacgaaaaaggaagcccttctggaagtgaaagaggaatcgatcaagaccaaaaatgaactggaaaaagagacgaaagaacgaagagcagagcttcagcgttatgagaaacgcgtcctggcaaaggaagaagcggtggataagcgttctgaagtggtcgaacaccgggagatgaatcttgcagcgaaggaagagcagatcaaggagcgtgaagcgaaggcagacgagttaaacagacaaagagtacaggaactggaaagaatctcaggacttacctccgaacaggcaaaagaatatctgttaaaaactgttgaagacgatgtgaagcatgattcagcaagaatgatcaaagagctggaaaatcaggcaaaagaggaagcaggaaagaaagcgaaagagtacgttgtcaatgcgattcagcgttgtgccgcggatcatgtggcagagacgacgatctccgtagtccagcttccaagtgacgagatgaaaggacgtatcattggccgtgagggtagaaatattcgtaccctcgagacattaaccggcgttgagctgattattgatgatacgccggaggcagttgtgctctccggatttgatccgatccggcgtgaagttgcgagaattgcattggaaaagctgatcgtggacggacggattcatccggccagaatcgaagagatggtcgaaaaggcacagaaagaagtagaatccatgattcgggaagagggagaggcggcagcactggaagtcggcgtacacggaattcatccggagctgattcgtttgcttggacgtatgaaattccgtacaagctatggtcagaacgcgctgaaacattctatcgaggtggcgcagcttgccggacttctggcaggagagatcggactggacgtccgggtggcaaagagagccggacttctgcacgacatcggaaagtctatcgatcacgatgtggaagggtcccatatccagattggcgtggatctgtgcagaaagtacaaggaatcagcagttgttatcaatgcagtggaagcacatcatggcgatgtggagccacagtcactgattgcttgcgcggtacaggcagccgatacgatttcggcggcaagaccgggtgcgcggcgtgagacattggaaacatatacaaacagattaaaacagttggaagatatcgcaaaccaatttaagggggtcgataagtcttttgctattcaggcgggaagagagattcgcgttatggtagttccagaacaaatatcagatgacgatatggtattactggcaagggagatttccaagcagattgagttcgagctggaatatcctggtcagattaaagtaaatgtaatccgagagtcaagagtcacggattacgcaaaatagatattagagtcgatattgtaaaagtagggatccctgatctactgcaaagtaggtcggggattcttttatatccatcaatcaaaggaggagtcaggaaaatgagcgaaaatattagacgagttggaagagaactgaaatataagggggcaattctggatgtatatacagatcatatggagtttgaaaacggcaacaaggcagaatgggattttatcaagcacaaaggggcggcggctgttgtggcagtggacaaggatggcagactgattatggtgcgccaataccggaatgctctggatcggtatacgctggagattccggcaggtgcgcttgacttccctggggaacctggaatcgtctgtgccggaagagaattagaggaggagaccggctttcactgtgagaagctggattggctcatcaacattcgcacgacagttgctttctgtaatgaaaagattgaggtgtatgtggcaagagatctgatcccgtcccatcagaatctggatgaggatgagtatattgagttggaacggtatacagtagaggaactgaaagaaaagatctttcagggagagatcgaggattctaaaaccatcgcctctattcttgcatatgatgcgaagtattgcagataggagaagaaattttcaaacaagtttgaactcagatttttgtcactttgtgcatggctcaactgtaacacaagatatattctcgcagggagattcaggaatacaaaatcggacaggtgaatatgtattagtatctgtttatgaggaggacaaagcttgtgagaatagaaagagcaaagcagtattttgcggtggcattcatggctggatttataggggggatcctgttcgctaatctgacggtgcgggactatgtgacgacgtccggcatctataacccctattttctaaaacagtatgctcagtcagatattcaggcgggagagtatattttgtatctgtgcggaatccgactgattcctcttgcgctgatcgcgcttttgggacagaccagggtgcggagaatactgagcatcgttgtattcgcatgggcagggttttctgctgggacgattgtctgtgcgggaattctgaatatgggcatccaggggattgtgttctgggtgatcgccatggttccccagtttttattttatgcctttgcgtatctgatcgtgctgtggtatttctttactgttcctcagtccaggtggaatttggggaagactttgtttgttcttctctttatggcggcagggctgattacggaggcctatgtgaatccgattctcatgcagatgtttctggatacattgtaagctgcaaaacgacagcctgagtttccatataagtggaacaagggctgtcgttttgtgttttggatacttccggtgatgaaattcagatcgtgcggaccagtactcgtactgccgcggcaaacacaaagatctgacttgcaagaagtccggtcagatatccgctcattccagtctgtggaatcaggagaaagacaccggcaatccggatgcaaagaccggtaaaattaatcagaaacgccatgttcgtatgtccgagaccgttcagaatactgatgtaggttgagtttgtgtagagaaacggacagataaaagcgagaacacggatgtaggaagccgcctccgggctgtggaagaccgcagcaccaagaaagtcggcaaaaaccagaaaaccaagagtgcagagaaaaccaagcacgaggcaggaaccgctgaccttgcggatgagctgacgaagagtccggttctggcttgcagcctgaatttcagccacagtagggagcatcatcatggaaatggaattggtgatggcggaagggaacaaaatacacggcatggcgatgccgtttaagattccatagtggctgagggctgaggaacgcgtaaatccgtagagcatcaggcttcttggaatagagacgacttccacgctttgaaggagattcagggagattcggttggctgtgacaggaacggcatgtttcagaatatcccgaagacattccagatagagggaaatcgtacgtctggagagggtactttttgtataaagtatccgtcggacggcaaaaatgctgtaaaaggctcctgcgatctcgcccagaacgagtccacacacggcaagaataatcccggccgatcccgtctccttcatggcggcggtgtagagcagatagactccaaggacacgggcgcactgttctacaagctgtgagatcccgggtatcttcgtctgttttaatcccagagaatatccacagatacaggagtggacactggcaaaaggcagcgcataggacatgacttttaataaaggctcacagcggctgtcattcaagaggaacacggcaatgtcctgtgcaaaaatctggatgcagaccatgcagagcaaagataatacagtagaaagaaacagggcggtctgaaaggatgccctggaaagatcgggccttccaagggaagcataccgggcggtcagacgggagagtgcagtctctatccctgcggcagacaaagaaatacaaagtgcgtaggcgggaaagatcagatggtagattccaatcccttccgtaccaaaggagcggctcaagaagatccggaagaaaaatccaatgacccttgagatcagaccgacaagcgtcaggacaaaagctccctttaaaaatatttttttacggctggaaagatgcataagatacctgactttgttttttactatgatattcttggatatgggttgacagaaccagatgggggtgctattctacaaaaggggaaaccctagtaaaaaagtaggattaaatgaggtgacaacgtgaaattatcaacaaaaggaagatacgggctgcgcgcaatgatcgatctggctgagttttctgagacagaaccggtctccatcggcagtatttcacaacgtcagggaatttcagaaagatatctggaacagttgatggccaagctgaaaaaggcggggctggtagagagtatccgtggtgcgggcggaggctatgtcatacatggagattcgggcagtatttccgtaggggacatcctacgtgcgttagagggaagcctggaagccgtgacgtgtgcggcgttccatgaggacgagtcctgcgaggcacaggatatctgtgcgaccaagtatgtctggaaaagaatcaatgagagtatccgtacgacagtggacgggatttatctggcgcagcttgtggaagagagcagaaagaataaggcaaagtgccacagacagatttccccggaagcgctctgcggcggttccagaaaggaaacaggaaaggaagaaaaccatgagtaaactgatctatttagataatgcggcaacgacaaagacagcaccggaagtggtggaggcgatgctcccgttttttacagaatattatgggaatccgtcgagcgtttacagttttgcgtccaagagtaaggaagcggtgacgagacagcgcgaaatcatcgcaggcgcactgggcgccaaagcgaacgagatctattttactgcaggcggcacggagagtgataactgggcaatcaaggcggcagcggaagcctatgagtccaaaggaaaacacattatcacatccaaaattgagcatcatgcggttctgcatacttgcgagtacctggagcaccgtggatttgaggtgacttacctgaatgtagatgaaaatggggtggtggacttagaagaattgaaacaggctatccggccggacacgattctgatctccatcatgtttgccaacaatgagatcggaacgatggaaccggtaagagagatcggggagattgcaaaggaacacgggattttattccacaccgatgcggtacaggcatttggccagatcccgattcaggtggatgagctgcatatcgacatgttgagtgccagcggtcacaaactcaatggaccgaaaggaatcggattcctctacatcagaaaggggctgcgtctgaagaatttcgtccatggcggagcgcaggagagaaagcgccgtgccggtacggagaatgtgcctggaatcgtgggtctcggaactgcggtggcacgggccatccgtacgatggaagaacggacaaaactggaaaaggagatccgagattacctgattgaccgggtattaaaggagattccttacacgaagctgaacggccatccgaccgaccggcttccaaacaatgcaaatttcagtttccggtttattgaaggagaagccatgctgctaagccttgatatggcaggaatctgtggatcgagcgggtctgcctgcacatccggctctctggatccgtcccatgtgcttctggcgatcgggcttccgcatgagattgctcacggatccctgcggctgactctaaacgaagagattacaaaggaagatatcgactatgtggtggaacatctgaaagagattatctcaaatctcagggccatgtctccgctctacgaagattttataaagaagcagacaaaataaagaaacggacttaggaggaaatcatcatatgtattcagaaaaggtaatggatcattttcagcatccgagaaatatgggagaaattgaaggcgcaagcggcgtcggaacggttggaaacgcaaagtgcggcgatatcatgcggatttatctggatattgacgagaatcagatcattcaggatgtaaagtttaaaacgtttggctgcggcgcggcagttgccacaagcagtatggccacggaactggtaaagggaaagcatatcaaagaggctatgcaggtgacgaacaaggcagtgatggaggcgcttgacgggcttccgccggtgaaagtacattgttctcttctggcggaggaggcgatccatgcggctctttgggattatgctcagaagaacggcatcgagattgacggactggagaaaccaaagtctgatatccacgaaggagaagaagaggaagacgaggaatattaaaggaaggcggacagacaaagaaagcatgaagaaagagaaagtagtcatcggtatgtccggcggagtggattcttccgtggcggcgtatcttctgaaagaagctggatacgatgtaaccggagtgacgatgatcacctgcgacgaggaacagtgcggacaggatccatcaagagacgcaaaaaaggtagcggaagaaatcgggatcccgcactatacagtggactttcggaaggaatttaaggccagtgtcatggactatttctgtgaagaatatctggaagggcgtacaccgaatccatgtgtggtctgcaaccgctttgtaaagtgggaggcactcctaaattgggctggacaaatcggcgcggataaaattgccaccgggcattatgcgaatatcattactcttccgaacggtcggtatgcagtggcgaatgctgatgtgtccagaaaagatcagacgtatgcactatacaatctgactcaggaacagctttctcataccctgatgccgatcggaacgtatgagaaggacgagattcgcaggattgctcagaaagccgggatttctgtggcacagaaagcggacagtcaggatatttgctttatcccggacggggattatgcttcctttatccggaattacacagggaatgtaccggcagaaggaaactttgtagacagacagggcaaaattcttgggagacacaagggaatgattcactatacggtaggacagagaaaggggcttggtattgccctcggatacccggcgttcgtacttgagattcggccaaagaccaatgaaatagtactcggaaatgacgaggaatccctgaccacaaccgtgcgggcacatctgttaaacgctatgggagtggaacattttgatgagatggaaggcagcaggctgtttgccaaaattcgctataatcatcggggcggatggtgttccttgaaagtgaccgggccggatgagatcacctgcacctttgaagaaccacagcgggcggtgacgccggggcaggctcttgtcctctatggtgacggttatattctgggaggaggacggatcctttgatccgaaaaggagaaccataatgataaaagcagattaccatatgcacacgtatttttcttcagactctgatacgccgccggaggcaatggcgcttggagcaatcaaaaaggggcttcgatggatttgtatcacagatcaccatgactgggattatccggaggataaaagtcagtttcgtatcgattttccacggtatcttccggcaatccgaaaactgaaagaagactttcgggaccggatctccattcagatgggagtcgagatcggattccagaaacatctagggccatattataaggaactggcagatacctatccgtttgattttataattggcagcacccatgtggtggatggcagagacccttataacggtgtgctgtttgagaatcaaacggatgccaaggtctatgagcgggcctttgaggagacgatggaaaacattcggatcatccgggactttgatgtcctgggacacatggactatattgtgcggtacggcagacaccaggcaaaggagtataactggaaaaactgctcagatctgatcgacgagattttgagatggctgatcgagcacgggaaaggcatcgagatgaacatggccggattcaagtatgggcttggtttctgccatccgtaccctgagatcatccgcagataccgggaacttggcggggagattatcaccgtaggatctgatgcgcatcagccggatcacatcgcctaccagtatgaggacgcgggtcggattctggaacagtgtggtttccggtattatacgatatttataggcagaaagccaaaatttttgaagatcaattaagctgtcttgcgattcagaacaaaagacttttgaggtctaaatcgcaaaagagaattgggaaaaacttggataaaaatagaaaagagacttgaattctggtattttttttagtacaatcattatggttgatgaatctttaacaaggagaaatcaccattgctgcattatgcagaggagaaactaaattaaactttaggaggaattaatcatggcagtaaaagtagcgattaatggttttggacgtatcggacgtcttgcattcagacaaatgttcggagcagaaggatacgaagttgttgcaatcaacgatcttacttccccgaagatgcttgctcacttattaaaatatgattcaacacagggaaaatacgcattagcagataaggtgacagcaggcgaagattccatcacagttgacggacaggaaatcaaaatttacgcaaaagcgaacgccgaagagcttccatggggagaaatcggagtcgacgttgttctggaatgtaccggattctacacatccaaagagaaagcttctgcacacatcaaagcaggcgcaaagaaagtcgttatttctgcaccagcaggaaatgatcttcctaccatcgtttacaatgtaaaccacaaacagcttacaaaagatgacaacatcatttccgcagcatcctgtacaacaaactgcttagcaccgatggcgaaagcactcaatgatcttgcaccgatcaaatccggtatcatgtgtacaatccatgcttacacaggagatcagatgactcttgacggaccgcagagaaaaggtgatttaagaagatcccgtgcagcagcagtgaatatcgtaccaaactctacaggagcagcaaaagccattggattagttattcctgaattaaacggtaaattaatcggatccgctcagcgtgtaccaacaccgacaggatctacaacaattttaactgctgttgttgagggaaatgttacaaaagaacagatcaacgaagcgatgaaagctgcgtccaacgaatcttacggatacaacgaagatgaaatcgtatccagcgatatcataggaatgacatatggttccttattcgacgcgacacagacaatggttctgccattggacaacggaacaacagaagttcaggttgtttcctggtatgacaatgaaaactcttacacaagtcagatggtaagaacaatcaaacatttcggaacattattataatctttcgtttccgaatcataagtagggcaggaattcctgccggaataagactcaacgaagggtccggtctcagtggggccggaccctttttgtcagaataaaaggaggcacagacaatgcttaataaaaaatctgtagacgatatcaatgtaaaagggaaaagagttcttgtaagatgcgactttaacgtgccgctgatagacggtaagatcacagatgagaaccgtcttgtagcagcgcttccgacaattaagaagctgattgctgacggcggaaaggtgatcctttgttctcaccttggaaaaccgaagggagaaccgaagccggaattatccttggcgccggttgcagtaagactttctgaattattaggacaggaagtcaagtttgccgcagatccggaagtggttggggcaaacgcaaaggcagcggtagaagcaatgaatgaaggagatgtggtacttctcgaaaatacacgttaccgtgcggaagagacaaaaaatgaggatacattcagtgcagagcttgcttatctttgcgacgtatttgtaaatgatgcctttggaactgctcacagagcacactgctccaatgtcggcgtgacaaaatttgtggacactgccgtagtcggatatctgatgcagaaagagattgatttcctcggaaatgcagtagagcatccggaaagaccattcgtagctatccttggcggagcaaaagtatccagcaagatttctgtgatcgagagacttcttgacaaggtagacacccttattatcggcggtggtatggcttatacattttctaaagcgcagggaggaaagattggtacttctctttgtgaggacgactatctggattacgcattaaatatggtcaaaaaggcagaagaaaagggtgtgaaacttcttcttccagttgataatatcatcggagatcagttttccaacgatgccaatacccagactgtagcggcaggagagattccggacggatgggaaggaatggacatcggaccaaagacagaagaaattttttccgcagccgtcaaagatgcaaagacagttgtatggaacggaccgatgggatgttttgaaatgccgaagttcgctcacggaacaaaagcagttgcggaagcacttgcaaatacagatgccgtaacgattatcggtggcggagactccgcggcggctgtcaatcagcttggatacggagataaaatgacacacatctccacaggcggcggcgcatccttagaattcctggaaggaaaagaattaccgggcgtagccgcagctaacgataagtaaacacttagcgaaagcaagcacgaaagtgcgccgcttgaggttagtgtttacttagtccgccgaagttgccgaagttatgcatgaggcgtacggaggcggacaaaccaaagaaaagcgaaagcggacacttagcgaaagcaagcacgaaagtgcgccgcttgaggttagtgtttacttagtccgccgaagttgccaaagttatgcatgaggtgtacggaggcggacaaaccaaagaaaagcgaaagcggacacttagcgaaagcaagcacgaaagtgcgccgcttgaggttagtgtttacttagtccgccgaagttgccgaagttatgcatgaggcgtacggaggcggacaaaccaaagaaaagcgaaagcggacacttagcgaaagcaagcacgaaagtgcaccgcttggagcgggtggataatgaagaaaagagggtttttaacatggcaagaaagaaaattattgctggaaactggaaaatgaatatgacaccatctcaggctgttgctcttgtaaatgagttaaagccgctggtggaaacagaggaagcagatgttgtattctgtgttccggctatcgatattatcccggctatggaggctgcaaagggcagcaacatcgtaatcggagcagaaaatatgtactatgaggaaaagggagcatatacaggagaaatcgctccggacatgctgacagacgctggcgtcaaatatgtaatcatcggacattccgagagaagagaatacttcaaagagacggacgaggacgtcaacaagaaagtattaaaggcgtttgagcatgatattacaccgatcatctgctgcggagagactcttgcacaaagagaacagggtgtgacaatggatttcgtacggatgcagatcaaaattgcattccagaatgtaacggcagaccaggcaaagacagcggtaatcgcatatgaaccgatctgggcgatcggaaccggaaagacagcaacaacagagcaggcacaggaggtttgtgcaggtatccgggcatgtatcggagaaatttatgacgacgcgacagctcaggcaatccgtatccagtatggcggctctgtaaatcctgccacggcaccggaattattcgcacagccggatattgatggcggactggttggaggcgcttctctgaaaccggatttcggtaaaatcgtaaactggaaataagacagactgccctgcggatttgtttccgcagggtttgctcgtccctgagatgactagtgtagtggtttttcccggaagtgtaagtaacagttcagccatgacagctcggattagccgctatgcagctttatcgccacttgcgtggcgaaattctcgttgatggcagagcgccatatacaaagcacacaaaaaatctttgttttcaaacaagtttgaactcagatttttgtgactttgtgcatggctgaactgttacggaaatattgcaaaatatgaccggggatagtacaataaaagggtcggatgatgacgggtaaagccggaatcggggaagggaaagtaagatggtaacgattaaagatattgcacaggcggctaacgtcagcgctatgaccgtctccaacgttatacatgggaggacgaaaaaggtttccaaggagacaaaggaaaggatcgaacagatcatggaggagatgcagtatgtcccaaatatgggagctcggatgctcgtccagaacgagtcgaggattatcggggtgatttccaactttctgtcggatacagagcatgagacactgtatcatccgcttgccgcggaaatgatcggtgagattgagaaggaagtacgtgcaaggggatattatttgatgctgtactcggcctctacggagaaggagatccgggatctgatccatacgtggaaggtggacggactgctgacgattgggattccgacggagatctgccgcaaacttggccaggagattaagatgccggctgtatttacggactgctatttccgggatgatgagagatacagaaatgtagggactgaggatgaagaaggcgcttatctggcagcatcctatctgattgaaaagggacaccgtaggattgcctttgtcacggatggcccgtatgacgagaacgaacggccgatggacggggcggaaagaaagctaaagggttatcaaagggcgcttcgggagtcacacctgtcgttcgacgaggagcacgtatacaggggcagtatgcaggtggaaaagcagcttaccatgatgcagtccctcattggtcatatctttgattatacggcagtgatcttcagcagggattcgtatgctttggaggcaatggattatttccgccatcacggcgtctggattccgaaggacatttccgtgatcgggtttgacgatcttacgatgtcaagacttgcctatcctagacttacaacgatccggcagggagccggcgaaaagggacgagaggccgccaagcttttgtttcaggcactggaagaaaaggaagaaaagaaggtagagatcagaattccggttcggctcatggagcgagagacagtaaaggaactctatgtataaagcccaggcgggatgagatttgcctgtacccccctgacggggacagatttcctgcgcttgaaagaaaaggggagagcatgtaaaattggaagatagaaataaaggagagaaaacaatgagtaagaaaccgacagtactgatgatcctggatggttacggattgagtgataaaatgaacggaaatgcggttgcggaggccaatactcctgttatggatcaattaatggcagagtatccgtttgttcggggaaacgcaagcggtatggccgtagggcttccggaaggacagatggggaattccgaagtcggacatttgaatatgggagccggcaggattgtttaccaggatctcaccaagatcacgaaggctatccaggacggagatttctttgagaatgaagcgctgcttgcagcctgtgccaatgtaaaagcgcatgacagtgccctgcacctgtacggtctggtatcagacggtggtgtacacagccataatacgcatatttacggacttctggaactggcaaagcgtcagggtatctccaaagtctatgtacactgtttcctggacggacgtgacactccaccggaatccggaaaggattatgtgcaggaactttccgataagatgaaagagatcggcattggtgagattgcgtctgtcatgggacgttattatgtgatggatagagataaccgctgggatcgtgtggagcttgcttataaggcgcttgtatatggagagggtaaccaggccaaggacgctgtggaggcgattcagaattcctatgacgatggaaaatcggatgaatttgttgttccggcagtcatcacaaaaggaggaaaaccggttgcgaccattcaggagaacgactccatcatcttctttaatttccgcccggatcgtgcaagggagattacaagagtattctgtgccgacgagtttgatggatttgacagaggagaacgtgtccgtacgacatatgtctgctttacagagtatgacgttaccatcccgaacaagatggttgcgttccataagacagagattacaaatacattcggagaatatcttgccaaaaaccatatgaagcaggcaagaattgcggagacagaaaaatacgcacatgtaactttcttcttcaacggtggggtagaagagccaaatgagggagaagaccgaatccttgtaaaatctccgaaggtagcaacttatgatctgaagccggaaatgagcgcctacgaagtttgtgacaagttggtagaagcgatcagatctttgaaatacgacgtcatcattatcaacttcgcaaacccggatatggttgggcataccggagtggaggctgcggcggtgaaagctattgaggctgtggatgaatgtgtcgggcggactgtggatgccatcaaagaggtggatggacagatgtttatctgtgcggatcatggaaacgcagagcagctcattgatgagacgacaggagagccatttaccgcacatacaacgaatcaggtaccatttatcatcgtcaatgcagatccatcctatggattacgggaaggcggatgcctagcggatatcgcaccgactctcattgagatgatgggaatgaaaaagccggaagagatgacaggctcctctctgctgattaaaaaataagatcaagataaaagaaaataaggaagaaccgaagcggaaagccagagcggcatactcccttcggttcttttttgtcagaatcaaaggacgtgtgccaatgtgtccgaaggcatcttgaaaggaaacataatgaataaattttaaaataaaaattcattttagacatgcagatttgcgaaaaattgaaaaaatagcaagaaaattgcaagaaagtcttgacggatagtcaaaacatagatagaataatattcagtgaaaaagaggaagggcggtagaaccatgacagcgtataaagatctgagtaaagacgagctgaaggctttgaaaaaagagttgaccaggaaatttgaagaggtaaaggcgaagggactgaaacttgatatgtcccgcggcaagccttctacagagcagctcaatctttcgatgggaatgatggatgttctgacaagcagttctgatctggtttgtgaggaaggtgtagactgcaggaactacggagtactagatggaatccgggaagcaaagcagcttctggcggatatgatggaagtaccaaaggacaatatcgtaattttcggaaattccagtctgaatgtcatgtatgataccgttgcacgttcgatgattcatggtgtgatgggaagtacaccgtggtgcaagcttgataaagtgaagttcttatgtccggtaccgggatatgaccgccatttcgcgattacagagcattttggcatcgagatgatcaatgttccgatgacccctacgggtccggatatggatatgatagagaagcttgtaagctcagatccggccatcaagggaatctggtgcgtgccgaagtattccaatccgcaggggatcacctactcggatgaaacggttcaccgctttgcaaaattgaatccagcagcagaggattttcggatctactgggataatgcctatggaattcatcacctctacgaggataaacaggactatctgatcgagattttgatggagtgtaagaaagaaggacacccggatatggtgtataagttttcttctacctccaagatcagtttcccgggatccgggattgcggcgattgcggcatccgatgccaatctggcagagatccgcgagcagatgaagatccagacgattgggcatgataagctcaatcagctccgacatgcgagatatttcaaaaatattcacggcatggttgagcatatgaagaaacatgcggcaagtatgagaccgaagtttgatacggtactggcatctttggaaaaagagctgggcggtcttgaaatcggaagctggcttgctccaagaggaggatactttatctcctttgattctttggacggatgcgctaaggctattgtggcaaaggcaaaagaggcaggactcattatgacgaacgccggagcgacgtatccgtatggcaaagacccgcatgacagtaatattcgtattgcgccatcttatccgactctggatgagatcaagcgggctatggaagtctttacactgagcgttaagcttgtcagtgtagagaagctccttgcacaagtaaaataatttatgccccttctttaaaatttatatatgccctatatgaaatgctgtatgcggatacgtcgtatctcacatacagcattttgcgtctaagagaaagagacgatgactggaaagtaaaaagaccgccggacgtatcgatggaggatacggatctcgaacggtcttttgcttttataaacaaatccctatttctgtcatatggacgcctggatatctttttccagatttttgtttgccgtggagagcatcagcttgattcggttaagctggttgacctcgctggcacctggatcatagtcgatagctacgatattggattccggatgaagtcgcctgagttccttaatgactccctttccgactacatgattcggcagacaggcaaacggctgggtgcagacgatgttcctggctccattctcaatgagttccagcatctccccggttaagaaccagccttcaccggtctggttaccaagagagacgatttcgcttgccatggaggcaaggtgctcaattctggacggcggggtgaaacgtttactttttttgtaagcgtccacagccggtttccggaaccattccagaacgctgattccaagattggcaagccgagcggaggacttcttcattcccagatgagtatgcttaaagttcgtattgtagaagcagtacagtaaaaagtccgccagatccggaacaacagcctcagcgccttcatgctccagaagatccaccagataattgttggccgccggaaggaatttgacaaggatctctccaacaacaccgacacgtggtttcttctcgtccgtaatcggaagcgtgtcgaaatcgtgaatgatctgccggcaaagctgtttgaagcggcgtctggaagggtagccttcggagacaaatttccggcagacaaaagcccatttctcatagagagcattggcagagcctttttcggcttcatacggacggatacgatacagacatctcataaagacgtcaccgagcaatgccgcatagataccgcgcagcgccagcatcggtgtaatcttaaatcctggattcttttccaatccgcttaagttgatggagatgaccgggatgtgctcatacccggctttttttaaagcacggcggataaatccgatatagttggacgcacggcagccgcctccggtctgggagataatcactgccagatggtctgtatcatattttccggagagaatcgcgtccatgatctgcccgacgaccatcagggatggatagcaggcgtcgttgttgacatatttcagtcctacattgactgcgtctttattatcatttggaagaacttcaatcttatagccggatgcgcggaaggccggttcaatcaggtcgaagtgaatcggcgacatctgcgggcagaggatcgtatacttcttcttcatctctttcgtaaacggtactttccggatcgcggcgctgtgaacttcccgtttttccttcttggcgtcccggacacggatcgcagccagaagagaacgaatccggattcttgccgctcccaggttgttgacctcgtcaattttcagtgaggtatagatctttccggaaccggtgagaatgtcggatacctcatctgtagtaacggcatctagcccgcagccgaaggaattaagctggatcagatccaggttttccgtcgtcttgacatagtttgccgccgcatagagacgggagtggtacatccactgatccatgacatttaacggacgttccaccggatttaagtgggagatggaatcttccgtcaggaccgcgattccgtaagaagtaataagctccggaattccgtggttgacctcagggtcatagtggtatggccgtcctgccaggacaataccgtggcgtccggtttgatccaggtaagcaagggtttcctcccctttttttcgaatatcctccctgcaggtttccagctctgcccagcctttgtgggcggcgtcccggattttttcctccggaatctggaatttctcccggaagatttccaccaggcggtctgccatgatttcttctgttgtcagggcaagaaacggattcataaaatcgacatgcccctggacgatctcgtccatattgttcttgatattttccgcgtaggaggtgacaatcgggcagttgtaatgattgttggcatccggaaattcatttctctcgtacggaatacaaggatagaaaatccggtccacattctgccggatcagccattccacatggccgtgcgccagctttgcggggtagcactcggactcactcggaatggattcgatgcccatctcatagatttttcgggaagaagcaggagagaggacaacggaaaatccaagctcagtgaagaaagtaaaccacaatggataatcctcgtacatattcagtacacgaggaaggccaatcgttccgtaaggcgcatcctctttggccaatggtttgtagccgaagtagcgttcattcttatacgcaaataagtttggaatatccgtatttgttttttcttttcccagacctcgttcacagcggtttccagtgataaagcgtctgccgccggtaaacttgttgatggtcagacgacagtggttggcacatctctggcattttgccatggaagtgtcgtaggtcaggttttcaatgtcctcgatagagagcatggtcgtctctttacagtcgtatgtatgataacgctccctggcgatcagagcagcgccaaaagcacccatgataccggcgatatccgggcggactgcctcacatcctgcgattttttcaaaacttctgaggaccgcgttgttatagaaggtaccaccctgcacgacgatattctttccaagctccgaagcgtccgataccttgattaccttaaacagggcattcttgataacagaataggcaagtccggcggaaatatccgcaacggaagctccctctttctgagcctgcttcaccttggagttcataaataccgtacatcgggtaccaaggtcaattggatgtcttgcataaagtgcttcatccgcaaagtcttctacggaataattcagcgacttggcaaaggtttctatgaaagaaccacatccggaggaacatgcctcattgagctgtacagagtcaactgtatgattcttaatcttgatacatttcatatcctggccgccgatatcgaggatacagtccacatccggctcgaagaaggaagcggcatagtagtgggatacggtctctacttcgccctcgtccagaagaaaggcagccttcatcagagcctctccgtatccggtggagcaggagtaagcgatccgtgcgccctccggcagcttggaataaatatccttaagcgctgtgatcgtagtggcaagcgggtctccgtcgtttccatggtagaaggaataaagaagtgttccgtcttcgccgaccagagcagcctttgtagtggtagaaccggcatcgatgcccaagtagacatttccctgataacttgccagatccttcacaggaacctggtgtttgtcatggcggtctttaaactcccggaaatcatcctcggaagagaaaagcggctccagacgctctacctcaaaatccatctggatatgatccgccagacgttgttgcagctcaatgatcgggatatccagatcttttttcgagttcagcgcagatcccaccgccgcaaagaggtgggagtttttcggcgcaatcgtatgctcgtcgtccagattcagagtccggataaaggcttcccggagctcagaaaggaaatgaagcggaccgcccagaaatgcgacgtgcccccggatcggctttccacatgccagtccactgatggtctgattgaccaccgcctggaaaatggaagcagccaggtcttctttcgcggctccatcgttgatgagaggctgaatgtctgtcttggcgaacacaccgcagcgcgcggcaatatcatataaagcagtataattctttgcatattcattcaggcccgtggcgtctgtctgcagcaaagaggccatttggtcgataaaggaaccggtacctccggcgcagattccgttcattctttgctccacgtttccattttcaaaatagataatcttcgcgtcctcgcctccgagctcgatggcaacatcggtctgcggtgcataatcctgtaaagccgtggatacggcgataacttcctggacaaacggaacaccaagatgctttgcaagtgtcagcccgccgcttccggtgattaccggggaggcgtggatcgccccgagctggtggacggctcttccaagcaaatcagaaagggtttcctgaatgtttgcgaaatgtcgttcgtaatctgagaataacagctcatttttctcgtcaagtactgcgatcttgacggtcgtagagccaatgtcaattcccagagtgaataaatccctttggctcatattacgttactccttttctattttgtacctgtagatgtatttcttcttatgattaatatatttttgcaacatcgattattatacgacaaaaagaagcaagatacaataaaatcttcctaaggaaaaatgaatttcttgtaaagtcttctgagctgattgacaaaaaaacattcagaagctacaatgagaatcgagtatgaaaggagagaaaaaatgaattggatttcacgtttagagcgtagattcggcagattcgcaatccctaatctgatgtatgtgatcatcattttgtatgcggtcggctttttgctgaacattctcaatccctatttttatatccagtatttgtcattgaatgtttcggagattctgcatggacagatttggaggattgttacctttttgatccagccgccgtcggacaatgcgatatttttgctgattgcactttacttttactatatgatcgggaacgcactggagcagacgtggggatcgttccgctttaacctgtatttttttacgggtgtgctgtttcacgtgattgcggcattccttatttatctgtttacaggacaggtttatctgctagggacgacgtatctgaacctgtctttgttttttgcttttgcagcggtttatccggatatggagttccttttgttttatcttattccggtgaaggcaaagtggctggcatggtttgatggggtattcttcgtctggaccgttgttcaggcgtttctcccgtcatacgggggaacatattccagctaccgggcgagcgcttttgcggcggttgtatcgcttctgaattttttgattttctatttttcgacgagaaattacgcaaagatttctccgaagcagcagaagagaaggcgggagttcaaaaagcagatgcaaagaagagagccaaatcactacagtgcacagccggacggacgggtgccgagacaccgttgtgctgtatgcggcaggaccgagctggatcacccggaactggaattcagatattgttccaaatgcaacggaaactatgagtattgtcaggatcacctatttacacacgaacatgtaaaatagaaacacgcagctgagtttacgaccagaaaggaatggaagagatgaagaagacgaagattgtatgtaccatggggccaaatgccaacgacgaggggctgatgcggaatctcgtgaaaaacgggatgaatatcgccagattcaacttttcacacggagattatgaggaacataagtatcgcatggatatgctgaagaagatccgggaggaggaaaagattccggttgcgattcttctggatacaaagggaccggagatccgcaccggtgtattaaaagacggtaagaaagtcatgctggaagcagggcaagagtttaccctgacgtctgaggaaatcataggggatcagaaacgggtttctatcacatataagggtctgacagaagatgtcatgccgggacgtaagattctgattgatgatggattgatcgaactggaagttctgagaattgagaaccatgatattgtctgccggatcatcaatggcggagagctcggtgaaaagaaggggatcaatgtgccgaatgtaccggtacgtcttcccgcgattacaaataaggatcgagaagatatcaagttcggcgtcactcaggggattgacttcattgcagcatcctttgtgcggaatgcagagtgtatcattgagatccgaagctggttaagagaatgtaatgctccgtacatcccgatcattgccaagatcgaaaacgcggagggaatccgtaacattgatgagattatccgaagcgcagatggtattatggtagcaagaggagatatgggcgtggagattcctgctcaggaagtgccgtatattcagaaagaaatcataaagaaatgtaacgataactttaagccggtcatcacagcaacgcagatgctggattccatgattcgtaatccgcgtccgactcgtgcggaggtaacggacgtagccaatgcggtttatgacgggacagacgctgttatgctttccggagagacggcacagggaaaatatccattggaggcacttcagatgatggtgcagattgtggagaatacagaaagccatctggattatgaagtccttctgaaaaaagcgcagcagcatagaaaacagagtatttccagtgcgattgggttttccactgtggcaacggcggacaatctgaatgcaaagtgtattgtagccccaacgatgtctggagcgacagcaaaagttgtatccaagtttaaaccaagggcagacgtgattggcgtcagtccggatgagtcgacgctccgcaggatgcagatttattggggagtacggccgctgaaatcgattccccttcgttctacggaagacgtttgtgagaatgccctggagatggtgaaggcgaagcagttcgtagagccaggagatgttgttgttttgacagcaggacttccggcgccaatgggaacttattcctactccggtaacggtgggagcaatatgatgcggattgcggtaattgaataagaaactgaatcaggacggatcggacagatccgtcctgatttatacttgactttctaaggagaaccgactatagtagtactataaagagctactaaggagagaaaatgggcaaagaacaatttaaggaacatttgatgaaatttgatttgacaagacaggaagccgcagtctatgagagtcttctggagaatggaaagctgaccggatatgaggccgccaagctgaccgggatttcccgttcgaatgtctatgtggcgcttgcgtccctgtgtgaaaagggagcggcctatctggaggcgagtgagaatggaaagcgttatctttctgtgccggtacaggagttttgcgaggacaagattgaccagttgaaaaaagaagaggactggcttgtaatgcatgcaccggttcggaaagaagaagaggaaggttatattacgatttccgggcaggagaccattgaggcgaaagcaagagctcttctgaaacgggcaaaagagagggtgtatctgtcttctggacaggcttttctggaggcagttctgccggagcttaccgagtttgccggagatggaaaaaaggtcgtcattattacggactgggaagcgtatgtcggccctgggaaggtatattacactgcagacaggaaaggacagatgggaatgattgtagattcctcctttattctgagcggagaatatagaaatcaggatcgcaatacctgtctgtatacaagccagcgcaactttgtggagatctttaaagaggcgatggcgaacgagataaaagtaattgagcttacgaaaggagaaaccaactgatggaaaagaaaccatttgtttccaaggaaaaactggaagagatcataaaggagttcccgacgccatttcatctgtacgatgagaaagggattcgtaagaatgcaaaagcactgaaagaagcgtttgcatggaacccaggctataaagaatatttcgcggtgaaagcgacgccgaatccgtttctcattcagattcttaaggagtacggctgcggctgcgactgttcttcctttacggaattaatgctttctgacgcgatcggtatgaaaggagaggatattatgttttcctctaacgacacgccggcagaagagttccgtcttgcagaccgtctgggagcaattatcaacctggatgatattacccatattgaatttttggagaaagccatcggccatattccggagacgatcagttgtcgttacaatccgggcggagtgttcaagattaccaatgatattatggatcatccgggagacgccaaatacgggatgacaacggagcagatcacggacgctttccgtattctgaaggaaaaaggagcaaaagagtttggaattcatgcgttcctggcaagcaataccgtgacgaacgaatactatccgatgttggcagaagtcctttttcagacagcggtccgtttaaaggaagagaccggagtgcatatcaagttcatcaatctgtccggtggaatcggaattccttaccacccggatcaggagccaaatgatatccgtgtgattggggaaggcgtaagaaaagcatacgaatccatccttgttccggccggaatgggagatgtggcgatttacaccgagcttggaagattcatgcttgcaccgtacggatgtctggtgacaaaagcgatccatgaaaagcatacccataaggagtacattggtgtagattcctgtgcggtcaatctgatgcgtccggccatgtatggtgcttatcatcatatcactgtgatgggaaaagagcacgctccgtgcgatcataaatatgacattacaggttccctttgcgagaacaatgacaagtttgcaatcgatcggatgcttccacagattgatatgggagacctgctcgtgatccatgataccggagctcatggatactccatgggttacaactataatggcaagctgaaatccgctgaagttctgctaaaagaagatggaagtgccaagctgatccgccgtgcggagacgccggcagactactttgcgacgtttgactgctttgatattggaaaagagctgatcgcagagtcaaataaaatttggaaataaatgtgaaaataatttcttgcaatcaaagaaaagttatgctataataattctcggcttcaatagctgagaaaagccggcgtgtcggaatggcagacgaggcagactcaaaatctgttgtgggcaaccacgtgcgggttcaagtcccgccgccggcaccagataatgataatccgaacccgattccaatcggggcggcttcggatttttagtatattttgagtgctaaagcaaaaacggtggtatcgtgagtgataccgccgtttttgtcataatgactttgacgacggtcagaaaggcgtttattggttctgggagagtaataccatataccacggaatcttgtaagaattgcattttgataattgcgtttttgcaattattctgtataatggagatatgcgaagaaagtgcgtgtctatgagtttatcaggaacatccggacagtacaggagaagcaacggaagcttcacacccttgattgtgacggcgtcggctacggaagggattggaaaggtcatgccattggatgaggaaaagtgagcggcaagaaatagtaacctggatttggaggattgattgtgaataaagaatggtcggaacttaacaaaacaatgcaaacacaaattaggaagaatgatacctatgaggcgggtatcgatactctatttgaactgcggaatcggttaatgaaaatcttaaccgtattctatagcgaattaaatagagaagaatttaatgccatcccttttctaaatgcagacggttatcatagcaaaaccattgcatattcaatctggcatatatttcgtatcgaagatatagttgcgcatatcttgataaacgaagacgaacaggtgttttgcacagggggttatcaggagagaatcaattcacccataataacaacaggcaatgaacttgaaaaacagcagattgcggatttttcaatgcagcttaatttgaaagagctttattcatatatttttgaggtaaaagcaagtactgaaaggatactcaaaagcctgtcttatgacgaaatgaaaaagaaggtatcaaaagaaagaaaagaatacttaaaatcgctaaatgtcgtaagcaatcatgaaaatgcgatttggctgattgattattggtgcaataaagatatacgaggactgatccaaatgccgttttcaagacattggattatgcacatagaagcaagtttacgtataaggaataaaatacatttataaatctttggagtgtaggtacatgaaaatgaaagaaaatattgtagctaagctgatatggaaagatgatagatgcgcctgcacacttgccgataaaatgatatattcgctcttttttcggtgcggacgttcataaaagaaaagagacaaaacagcggaaccattcatcttgaggatttcgctgtttttgtatattaagggaaaggtacaatgatcgataacaagatttcaggagggtgagacttttgaacagaaaatatgtcaaagaagcgataggctgcatgatgatatcagtggtaattgttttactactgctgggaatggttgctgtatttgaatatctggaaatccatgttccgggcagcagggaaatgtggatcgggctcattggagcagtacttgggggcgcgtttactctgataggagtcctcattacgctttatcatcagaaagagagcaatgaggagaacagacgtctggaatatatgccgattttaggatttgaagctattatgagtgagacagatccagagctcattttgacaatcacagaagaaggggtgataacgagtggttttttctgcctgaaacagaaaatttgctcgcagattgagataaaaacaatcaatcataattgtgtttttgattttcagattgagggatgtgcagtcaacgggaaaaagattgcttctggaagtgctttttatccggcaaaaagacgtctgacagataaagaagctaccagcattgtgtttgattatgatattaatacaaatgttttttgtctgcttagaatctcatataaggatgtatttggtgcttcctattatcaggacctgccatttacctatgctgagacgatctatgatggtgaagacagggtaaggcagattgtagagcttagggatgtaaaggctccgacactccagaaggatgcgaaagatctggaagaagctgtaaaagactatctcgattacaaggtattttgtgaagcatcttcgtatatatcctgatgagcgagaagattagccagcatatcactcaggacaacaagatcggcggccagcatggtaagttcctgctctgacagacactctgaaagtttgcaggcgatggtagaaagatagaacagattggaacattgtttcatagtataacccttgaacacgattttgtgattataatatacggaaagagagccaaacgtgacagaaggctctctattttttgtggttattagatctaaaatcatggaactgtaatcttaaaaagggaacaggagagatctctcccttccgcccctgtagtatattatttgtttataaagtccttttgattttatccttcaaaaaagtaattctttttatatctcataaaatacttaaaaagatattttgatattcgttatagaaaataatttcttttgcagtacagtgacacactgtattgttgtcattgatatttattcatctattgatataattgcataaattaaaaacttggttttgaagaataattgtatttgttgcacaaaaatcaagtaaaaaatttgtcaattattctgcggaaaaggtaactgtcaacagttgacttttaaacacggggggggggtataatgagcataaggattttcacaaagtaaagtgaaaaaggagagcactatgacaaaaacacccatatcaagaaaaacattaagagagcaggtagccgagattttaaggaaaaagattctgaatggagatattcagtctggggaacggattgtagaggctgatctggcaagggagcttcagatgagccgggggccggttcgggaggcgctacgtcaaatcgaggaagagggtttggttgtctacgagcctcacaagggctgtgtcgtcaagacgatgacgtatgatgagatgcaggaagcttatctgatacgatccacactggaaatcctggcagtccgtatgtgttccggaaagctttcaaaagagcttgataccaaaatggagcagaatctggttgaaatcgggaaagcggcggatgccagggatctttaccaggtaatcgaactggatgaacagtttcattcttacgtggtgatggcatcccacagtgaaaagctctacaaggtttggaagtcgctggaaagtgggaatacagcagcatactacaccatgagatcggaatcattgatgccatatgaatatattcaacaaaaccaccagaagattttggatgcgttccgggccaagtctgtggaggagatctgtgaaaagatccgccggcattatatgatcgtgccggagacgctgttccaggagcttcagaagaaaagacagtcagaggcaagctgacgggaaaagaagggagagaaaaagatgctgaaatttattggaaaacgactggcgtacgcaattcttacattatttttgattgcgaccgctacattctttcttgtggcaggggcaccgggagatccgattgcggcaaaggtcggacagatgccggagcaggcgcaggaaattattgagaagaaatatgggctggataagccggtatttcagcgttacacaacctatatgaagaatctgattactactggagattttggagagtccatcgtctatacaggaaagtccgccaatgatgtgatcaaagaaaatacgtggacgtccgccaagatcggtcttctggccatcttgtttcaggtaacaatcggtgtggctcttggaatgatagcggcactgaaccgggggaagccggtcgatcatgtgattcgggtactggtcgtactcgcgatctgtgtcccgagcttcgtatttgccgccgtgcttcagtatttcctggcatttaagtggaaacttgttccggtatttggctggggacagttaaaacattacatccttccggttgcggcctatgcgatcggcggaatcgcttcttatacgaagtacacgagaagcagcatgatttctgtgattggagaggattatattgtcaccgcacaggcgaaaggctgcaagagaaaacggatcgtcaaaaagcatgttctgaggaattcgatgattccaatcattactatgatcgggcctgcgatttccggagtgtttgccggttcttttattctcgaaaaaatgttttccatcccgggacttggcttttattatgtaaaagccgtatccgacaatgattacaccatgattatcgggcttaccatcttttttgcaatcctgtttgtaggagcgctgattgtggtagatattctatatggtatcgcggatcctagaattcgtgtggcaaaaggcaagaaatagaaaatgaggtgatcattatggaaatgaaagaaaagagaaatagcgagatgtccgttggggatacggaggacttgtttaaaagaatcggaacagaaggactctcgggggaggagatcggagcgaaatcgcttacatactgggcggatgtctggagaagatttcgtgcaaataagctggcgatttttggtttgatacttcttaccttgattgtgctgctgctgtttgttggcccggtgatttccggaaaagattatcaatacatcaatgcggctttgaaaaatcaaggcccgaattcggaatactggttcggaacagatgatatgggacgagaccttttcacacgtgtctgtgtcggcggacggatttcgatttatattggtctgtgctgtacagcggtcatgtttgtgatcggagctttagccggggctttggcaggattgaaagggggtcttgtggatgatattatcatgcgtatctgtgagctgatcggaaaccttccatatctgattattgtcacgatcctttcgatggtgatgggaagaagtttgttttctcttgtatttgccatgagccttacggcatgggtcggcacagcccgaatggtaagagggcagattcttcagatcaaagaacaggactatgtgcaggcagcaagagcgcttggcgcttccacgggaagaatcattatcaagcatctgttaccaaatacacttggaattatcatggtagacattacgatgtcaattccaggatttgtattcagtgaagcgtttttaagttatatcggtcttggagtcagacctccggagacgagttggggagctttggcgtccgcaggacagcagcagttgatgttttatccccaccagttattcttcccatgtcttctgattgtcctgaccatgttgtcgtttcatctgattggagacggactttctgacgcattggatccgaaactgagaaaataggaggcatcgtgatgagtgaaaatatattggaagtaaaaaatttgcatgtttcctttaaaacctatgccgggatatcacatgcagtaagaggagtggatttcagtctgagaaagggagagacacttgcgattgtaggggaatccggatgcggaaagactgtcacgtccaaagcgattatggggcttttgcctgctcagaataccatgattgataaaagtaatggagcacagattctctttcagggagacaatctgctggactatacggaaaatcagatgacagagatcaggggaagtaaaatttctatgatttttcaggatccgatgacatcgttgaatccaacaatgagaatcggggagcagattgcggaaagtattttgatccatactcagacatcaaaggagcatgccatgaaagaggcagagagaatgttggagttggtaaagattccgaatgcaccaaagagaatgagacagtatccgtttgagttttccggaggaatgaggcaaagagccatgattgcggttgctcttgcatgtaagccggaaattctgattgcggatgagcctacgacagcgctggatgttactatccaggcacagattatggagctgatcggaagtcttcagaaagaattagatatggcagtcattcttgtaacacatgatcttggcgtagtggctagtgtggcagattatattcaggttatgtatgcgggcaagattgtggaaaggggtacggtggacgaaattttctaccactttactcatccatatacaagggcgcttttgaattctgttccgaaaattcatacgaataataaagaaactttgtattctctgaaggggacccctccggatctgatcaatcctccaaaaggatgctcttttgcaccacgttgcgaatatggcatgaaaatctgtaggatgcagtatcctgaggagacgaaattcagtcattctcagaaatgttcctgctggcttcatcatccaaaggcggatgtcagcggacttccggaaaatatggtcagaagggggaatcagtaatgaatgagaaagaggttctgattgaagtcaaagacttaaggaaatattttcaggtaggacgccatcaggtattaaaagccgtggacggggtcagcttcaagatttacaaaggcgagacgctgggacttgtcggggagtccggctgtgggaagacgacatgcggcaaaaccgtgatgggactttatgacgcaaccgggggagaagtgatttttgacggagtcgagattcatagtcttcataaaaaagagaaaaaggaattcacaaaaagagcgcagattattttccaggatccgtattcttcgctgaatccaagaatgacagtgggggatattattggggaaggaattgatatccataagctgtatacagggaaagagcggcaggagaaaatctacgaactgctggaactggtgggcttgaacagggaacatgccctacgtttcccgcacgaattttcgggaggtcaaaggcagaggatcggaattgcaagagcgctcgccattgaaccggaattcattgtctgtgacgagccgatttccgctttggatgtatcgatccaggcacagattgtgaatctgctgatcgagctgcaaaagaaaaggaatctgacctacctctttattgcccatgacctttccatggtcaaacatatctcagaccgggtgggagtgatgtatcttggaaacatggtggaattcgcgtccagtgatgagctgtatagcaagcctctgcatccttatacaaaggctctgatgtcggccatcccgatcccagatccgaaagaagagaagaagaaaacaaggattcccatcgaaggtgagatcccaagtccggtgaatccaaagccgggatgccggtttgcggcacggtgtaaatatgcgacggaactttgccgcagcgagacgccgaaactggaggagatggaagaaggacattatgtggcctgccaccgggtaaaggagatctgataagagaggagatcttatgtgacgagcattagaagcgcaagtttatgattccaaatccgaagctgtacggatttaggataataaaatttttcaataaaggaggaatattatgaaactgaggaaaaaagtgctggcgggacttcttgctgctgccatgacagcagggcttcttgcggggtgcgggggcgaagaaaaatcaggcggcggaggtggtggatctgccgagcaggtgctgaatatttctactaacagtgtggtagtcggcttaaatccgctggtcaacacaacgggaccggacaataaagcgcacaatatgatttatgatccgcttgtacgggatcgttcggcaaaggacaatacggatgagatcgtgccggcagccgctgaaagctgggacgtgagtgaggacgggctgacgtacacctttcatatgaatccggacgcgaagtggagcgatggatcgaaggtgacggcaaacgattttgagtttacgttcaagaagatggccgatccgaatacggccgcgacaaatgcatggctgtttgatggggttattgagaatttctctgaggcgttgtataataacggaaagacgccggacgaaatcggcgtcgcagcgacagatgagaatacactggaaatccaactggtgcatccggcttcctatttcctggagctggtagcgggttccgtttatccggtcaatgaggcaaagtatgaagagttcggttccgattacggcacagctccggacaaaactgtctacaatggacctctgaaagtgacaagttggaatcagaacacggaaatgaatctggagcagaatgatcagtactggggaaaagacgatatgaagcttcaaaaagtcaatcttcggattattcaggatccttccaccgctgtccaggcatttattaatggtgaactggatgtagtgagcacctctgatacgaactggggcaagacaatttcagcggcaggcgattccgaagagatcacagttccgacaaacgcaccggaatttttcatgttcaacctgaaaaatgaatacctgagtaatacaaaaatccgtcaggcgctttccattgcttttgacagacaggagatggtggatgctctgcgtgatggaaaatctgaaccgatctattctctgatgccggatacaatgaaagtaggggaaaagacatatacggagctggtagatggaaagaaccattttgtttccgagatgcaggagcagtatccggatccgaaggtgcttctccaggagggattgcaagagcttggaaaaagcacagacccgtctcaggtaacgattcgctatgcaagccgtggaacagatgaactgtctaagaaaatcggggagtggatgaagcagacatgggaagaaaatcttggtatcaatgtacagattgatatgatggaatggaacattatgtgggacaagattgatgcaggggattacgatattgcccaaggcggatggggaccgtattacaatgagccgagtgcatttcttcagctttttgatccagataatggttatttcaactctgcaaaaacaggatggacaaatgaagagtccaaacagtataaagaactgcttgaaaaagctaaaaatatcgtagacgacaaagaaaaggcagagatttatctggaggcggaaaatctggttgtcggaaatgcattgattgcgccgacttacctggaggcatcaccgacctatgtgaaaaactatgtgaaaaactattttgtaacgacaaatggaacagtggatttttcacaggtatcgattgaaaagtagagaacagacagatcagaaggccaatcacaagcgggtggttggcctttttcaaaagagaaggagggaaagcagatgtacctgattaagaacggtgttgtccatgtgggggacggcacgattctgaaggactgcgatattttaacaaaaggatcaacgatccaaaagattggccagggacttgattgtcccgaggctgaggtggtcgatgcgtcgggctgcgaggtatttcctggatttatcgatccacattcgatgattggagcgcttggaattccatccagaagtctggataaccaggaaaaatccgatcctatcacaccagagctgaatgtcaagtactccgtagatcctgacgaactaaacggacaggaattttataaaagcggaatcaccacggtcggactggctccggggaatactaatatcatgggcggacagattgtggtggtgaaaactgcgcctatgaaaatgagcaggcgtatagtgaaagaaaaagcggcattaaaatgcagcgttacggcgtcggtcaaatcggtttatgggaagcaaaacaagatgccgatgacaaggatgggatcgttctggatgcttgaggaggcaatccgaaaatcagaaaaaagcggcggaggtacagaaaatcaagagagagatcgggtgatccaggacgtctttgacaaaaaaaagatgccagtctttgcggcggcagagcggatcggggagatcgcaggtctacatcatttgatggaagaaaagcaggtgccattcgtcctggtggacgggtatgagtttggagatgtcatagaagatatgaagcgtcagcatacgggactaatccttggcaatgtaaacgatggatccaggattgcaaagcatggaatggatcttggtaaaataaaggaattggcagaaaacggaaacaagatagcttttaccaattccagcagtggctcttccgaaggaagagaagtgttcctctggacagccattgaggtattccgtgccggcgtggatgcagaagaagtggtaaagatgatgacgatacatccggccgccatgcttggcgtgggagacagaattggagcgctgcgggaaggaatggacgccgatctttctatctatacgggacatccggtgaaaacatatgcggccagagtcaaacacagtatcatcaacggggaggtggtcttctgatggaacacatattgattcaaaacgggacattatatacgatggaagagggaacagaaccatttcagggagatctgcttgtcgcagaaggaaaaatcaaaagcatcgcaaaagagatttgtccggcaacactgccgtctgatacgaaagtggtggatgcgtccggaatgaacatctttccgggactgattgacgcacattcccatatcggactctttgattttaacggtgagaattcggtcgacgacgctaacgaaatgacggggcctgtcactttgtccgtggacgccagatacggtgtcaaccccaaggcaaaagaattccgggtggcatatgagcacggcattacaaccatgcttctgacaccgggaagcggcaatgtattctgtggtctgccgtttgccctgaaaacatatggtgacaatgtatttgacatgtctatcaaagcgccatgtgcggtgaagattgctcttggggggaatccgaaagggacctacggggatcgaaaccagcttccgatgacgaggatgggcgtggcaaaggtgctctgggaaacctttggaaaggcaaaagcctatcagaaagcaaaagaaaaaggagaagccttggagtatgacccggatatggaggcgatgcttttggtacttcgtggagagatcccgtgcaagattcactgtacccagtatgatatgctgacagcgatcgaagtggcgaaggcctttggggtacgtttttctctggaacatgcatggggcgccacagattatatggatgagattgtagagagtgggtgcgacatctgttatggaccgatcgggacataccgctgcgtgggagaacgaaggaaggtagatattgaggcggtaaagacattggacgagcgaggggttacggtagcgctgattacggattctccgattctcagcgaagagtctttgtatcaccacatcggagaggctgttcgggagggggtaccgtggatgcgggctcttcgaatggtaacggtgaatccgtcgaagattctcggagtggaagagcggatcggcactcttacagagggaaaagacgcagatttaattctggtgaaaggacggctgggattggatacagatgcaaaagtactttgtacgatgataaacgggcagattgtatatcagagcacacgttaaagaggatcgggaatgagcaggtgctgatcccggatccatctatcaccaccggaaagaccatcttaatgccagagaatatactatggcggcaaggcatgcggcatggagaggacaaaatctccagccgcttttctcgttttataggaaactgcgttatcagaaaggattacaaaaaacagttgaaagaacgggcaatgtcggttataatacaatctggcggaaacgccggcacaaagaaaaatggaaacataagggagtagttggcacttttacagtgtgacaaagtcaacatattggagagatcctggctttgtatgaaacagcgagacttatctgtatcagacgatgatatgggtaggactcgattttttttgcccttttgtaaacaggttgtgcgtattcaaaggaagaaaagaagaagcaggaggaaactgaacaatgggatttttagagctgttctttatcgcggtgggtcttgccatggatgcctttgcggtgtcgatctgtaaaggactgtccgtaggtgtggcaaagccaaaatacgtgttgtgcgtaggactttattttggaggatttcaggcgctgatgccgacgataggctattttgtaggagtcaatttccggggagccatcgagagtgtggatcactggattgcgtttattttgctggctatcatcggaggaaatatgatccgggagtccagaggagaagaagaatgtgtgggagcccgttttgatgtaaaagagatgacggcgcttgcggttgccaccagcatcgatgcattggcagttggtgtaacattcgcttttctggacgttagtatcgctccggcagcggcgtttatcggctgcctgacgtttgcgatttcggcggcaggactgaaaatcggtacggtttttggaacaaagtatagaaacaaagcagagtgttttgggggaattgtcctgattctgatcggtctgaaaatcctctttgagcatcttggaatattttagcgttgtaaaagtggacaaaacgaagtaaaataaaagaagtattttaacaaagaacggagtttggcgatgagtgaaaaacagtttcaggatcagaaaatcgttctgattgacggacacagtattttgaaccgggcgttttacggtcttccggacctgacgaatgcggaaggacttcacaccaatgcggtgtatggatttttgaatattctttttaaaatactggatgaggaaaagccggaatttttgaccgttgcgtttgacgtccacgcaccgacgtttcggcatgagatgtacgaagaatataagggcaccagaaagccgatggctgaggaactgcgtgaacaggttcccctgatgaaagatgttttaaaggccatgggtatccgtctgattgagaaggcgggactggaagcggacgatctgatcgggacgctttcgaggcgctgtgaggaggcggggatggatgtggttgtcctttccggagaccgggatctcttacagcttgctacaaagaaggtcaagatccggattcccaagacgaaaggcggcaggaccgaagtagaggactatctggcggcggacgtcaaggagaagtaccaggtgactccgcaggagtttattgacgtcaaagcgttgatgggtgatacttccgacaatattccgggggtgccaagtatcggagagaagacggcgacgaaaatcattgtggaataccaaacgattgaaaatgcgtatgcccatgtagaggaaatcaagcctccaagggcgtccaaagccctgaaggaacattatgatatggcgcggatgagtaaagaactggccaccatcaacgtccatgcggatttcccttacgaggtggaagagggacggatcgggaatctctttacgaaagaggcgtacgagtggtttcagagacttcagtttaaaaatctgctcggaaagtttgagattcaggtgccagccaatgccatcgaagatagattccggacggtgacagatccggcagaggcccaggcagtgctggggcgtgccgcgtccgcaaagacagtgggtatcgctctggagaaaaacagggagaatatgcttccactcttttccatgggaagtgaaattaccggcgcggcattcgctttttcccatgacggcaaggaagaggtcgtctctattttggtaggaggcacattgacagcggaagcgctgctgaagcagatttccgcacttacggagagcagggcagaaatttccatgttcgatgtgaagcaggatatgaaaaacttccgggtgtgcagaccggagaatgtctttgacgttcatgtggcggcatatctgctaaatccgctgaaaagctcttatgagccgaatgatgtcgccagagaatatctggatctgacgattgacgggaaactctctgaggagaagaagcgttgttatgaggcgtacaccatgtaccagggagcggccatcctccgggagaaactgcaagagagcggtatggaggcgctttttgatgaaattgagatgccgcttgtctttgccttgtttgatatggagcaggcaggtgtgaaagtggaggcgcgagagctgaaagcctatggagaggagcttggtgtccagattgaaaagctggaaacggagatttttgagctggcgggggaggaattcaatatcaattccccgaaacagcttggagctgtgctctttgagcatttacagcttccgcacgggaagaagactaagaccggatattccacggcggcggacattctggagaagctggcgccggattatccgatcgtttccaagattctggaataccgtcagattgcaaagttaaaatctacctatgcggacgggctggcgcattttattcaggatgacaatcggatttacggcacctttcatcagactgtgacagctacggggcgaatcagcagtaccgagccgaacctccagaatatcccgatccggatggagctgggacggcagatccggaaagtatttgtgcctaaggagggttttcaatttgtggatgcggattattctcagattgaacttcggattctggcacactgttcagacgacgaggcgctgatccaggcataccgggaggcaaaagatattcaccgcacgaccgcgtcccaggtgttccatacccctttcgaggaggtgacggatcttcagaggagaaacgccaaggcagtcaacttcggcattgtctacggaatcagttcctttggacttagccaggatttaagtattacgagaaaagaggcggcagagtatatcgaccgttattttgagacttatccgggtgtgaaaaaatatctggacggcgaggtggcatttgccaaagaacacggctatgtgacgacgatgttcgggcgcagacgtccagttcctgagctttcttccagcaatttcatgcagagaagtttcggagaacgggtggcgatgaattccccgatccagggagcggcggcagatattatgaagatcgccatgattcgggtcaacagacggctcaaggaggaaaatctggaatcgagaatcgttatccaggtacacgatgagcttttagtggaggcgaagaacgaggaagttgagcaggtcaaagcgattctcaaagaagagatggagcatgccgccagtctgaaagtcccgctgattgctgacatgagcgtaggtgccaactggtatgaggcaaaataggttatagatgggtgtcagatgaaaacgataggaattacaggaggagtcggggccgggaagagtacggtcctagacttcttacgagaaacatatcaggcctccgtctgtgaggcggacaaggtagcccacgaactgcaaaggccgggggagggctgctatcaggagattctgaaagtattcggaccggagatcttgtgtgacgatcagaccatcgaccggaaacggcttggcagcatcgtctttgccgatgtggagaaattaaaacggctgaatgggatcgtacaccctaaagtcaaggaatggatccgcaaaaaacaggaagaagagcaacgggccgggacgaagctttttattatagaagcggcgcttctgctcgaagatcattatgaggaaatctgtgatgagctctggtacatccgtaccccggaggcagtgcggagaaggcgtctcagggaaagccggggatattcggatgagcggatcaaaggaattatgcagaatcagaagtcagaaacacagtttctgaaagcgtgtgacagggtcatagaaaatggagaggatttcaaagagacttgtatccagatccaaaaagcgttagaatcgtactagaaaccgtgaaggagaagaagaacatgagaatttgcagtatagccagcggaagcagcggaaactgtatttatgtgggagatgagcatacccatgtgctggtggataccgggatcagcaagaagcggatcgaagagggattaaaagatctggacgtcaaaggggatgagctggatggtatttttattacccacgagcatgcggatcatattcaagggctgggtgtattcagcagaaaatacgggatccccatctatgctacaaagggcaccatcgagggaatcaaagattaccggagtcttggaaagatgccggagggacttctgcacgagatccgtgcagacgagccttttactttaaaggagctgacagtatgtccgtttcggatttcccacgacgcaaatgaaccgaccggatatcggtttgaaaatggtgaaaaatcagcggccgtagctacggatcttggaatctacgatgattatactgtggagaatctgaaaggtctggacgccatccttttagaggcaaaccatgatatacatatgctggaggtaggagtttatccatactatttaaaacagcgggtaatgggaaagcagggccatctttccaatgagttatcaggcagacttctgtgcgatattctgcacgacgatctaaaatgcgtgatgcttgggcatttgagcaaagagaataattacgcagagctggcttatgagactgtgaagctggaagtcactcttggtaacaatccgtataaaggagaggatatcccgatcatggtagccaaacgggataccaggtcggaaattatcactgtttaggaagaaaaggagaggatgatatgagtcgtgttgccgttttaactgacagcaacagtggaatcacacaagcagcagggaaggaactgggagtaggaatccttccaatgccgttttttattgacggagaagaatattttgaagagatcaccttatcccagaaggagttttatgagcgtttgaaagcaaaccatgacgttaagacatcccagccggcgcccggagacgtgatgggaatgtgggacaagtatttggaagagtatgatgaggttgtctacattccgatgtcaagtggtctgagcagttcctgtgagacggccatcatgctgtctacagactatgacggtaaagtacaggttgtcaacaaccagagaatttccgtgacacagaggcagtcggtgctggacgcgctgaagcttcgggacgcgggaaagaatgcggccgagatcaaagagattctggaaaaggtcaaactggaatccagtatttatattactgtggatacgctcaagtatttaaagaaaggcggacgcattacgccggcggcagcggcgattggtacagttctgaatttaaagccggtgcttcagattcagggcgagaagctagacgcttacgctaaagttcgcggatggaagcaggcgaagaagacgatgctggacgccattgagaaggatatgctgcaccgtttcggaaagcagccggttcatttggaagcagcttatacctgctctgaggaagaggcacagaagtggaaagaggagatcgaggatcgtttcccggaatatgaggtggatatggatccgctttctcttagcgttgcctgtcatattgggccgggagcaatggcagtagcgtgctccaaagtgctgacagtgtaaaaggaaaacagactgacaggacactgtatcagttgtaaaaaagagctctttaccggacaggaggatctgacgggcctcatgttcgttcggtaaagagctcttttatcttttccaagagaaggggaatccggtatttatacgatgacgagagggtggctgtactcgttgcaaaacggagtcttaaacttattgctaatgaccgactcgtacagatttgacgcaaaaatatccagatgaagcatctgctgtccatgttcggaaagggagtccatatcactgagctttggaagcagcggaatccgggaattcttcttgataaaggaaagaatttccttttccttctggacgaagccaagcatccgagcataatggataaagccgtcggcagctacacgatccagaaaagaagcctggatgccgagcatgatatgaagcagacaacggctgatccgggagtaggtcacctcttttgtctttatcaggtcacagaactggtcaaagttctgatagctgttgagatgcttcataatacgattggcaagctcctcggagacatccgcatatcgggtaagcgttccgcggctttcccgcataagctgatatttgataagcagggaaaaatcattgctgtatatcgggtagcgggttagatgagtcctctccagcaggttgacacattcccgcggcacatgatcttccagccgtgccaaaatggaggagagctttggctcgtcgtaaggtgtgtctttcactgtgcgtagagaacttcctgaaaaaaggagaagtctgcggatggcggtagcggaactgaaattcccggccggttctagggtatcagcatgataccgggagtctttccggagagtggtataaggccggattgtgctttcctgccggatcagtgctttgatgtattccactcccagtgtattgttcgggcttgccaaaatccgggacagggcaggatcgtgaagataatcctgcagagcccgttctctggcagatggaaagggaagcccctctttgagcgaagcacgaaggagagcccggtattcttcaggctcatcggagagcacttcagcgatccgggtgagtggctgaatatctccacattcgctcccgaaacacagggcgtccacgcagcccagactgtccagaagggccacggcgccctgggcaaaatattccgcgcttcccgtggcaaagcataccggaagttccaggacgagagaagccccggattttaaagctactttggctcttaggtgttttggcatgatggcaggagcgccgcgctgtacaaaattaccgctcatcacaacaatgacagtatccgctcctgtcacttcttttgccttttgtatatgatattcgtgcccattgtggaaaggattgtattctgcaattaaaccaactattttcataatgtccttgtaatatcctccttattgtgattatactataaaaggaatccgcttgcaaaaaaatctggtggaacgaaagggggatacacatggaccagaaagcgctgttggcacttttggaagaacgaaagtttaaagaattaaaagaagaactgggaaatatgtaccccgttgacatcgcggaattgctggaggaggtagacgaaagacagatgatactgattttccgtctgctcggcaaggaagaggcggcggagacttttacggatatgagcagtgaaacaagagaattcctgattaatgccttgacagattccgagctggaagaggtcatggacgagatgtacgtggatgacacggtggacgtcctggaagagatgcctgctaatgtggtagacagacttctgatggcaacagatgaggagacaagggtgcagattaacgccctgttacagtatccggaagacagcgccggaagcgtgatgaatattgattatgtcagtttccgaaaagagatgacggtagaggaggcgattctcaaaattcgccaggttggcatcaaccgggaaaccatttatacctgttatgtgacggagaagaagaagctcatcggatgggtggatatcaaggacctcctgacttccagcgagagcagaacgattgaggagatcatggataccaacattctttatgcacatacccacgatgaccaggaagaagtggctaccatgatccgcaaatacggacttgtagcaattccgattgtcgactatgagatgtgtatggtcggtatcgttaccgttgacgacgctatgatcgttttacaggaagaggcaacggaggatatcagcatgatggccggtgtcagcccgaacgatgattcctacttcggaacgagcgtctggcgacatgccctttccagaatcccatggcttttgtttctgatgctgtcagctacggtaagcggccttctgcttgcctattatgaaaacgcaatgtcggccatgccgattttaattaccctgatcccaatgctgatgggtaccggcgggaattgcggttcccagagctctaccctgatgatccggggactggccgttggtgagatccggttcaaggatctttttcgggtgatttttaaggagattcggattgcgctcattgtcggtgtggtactgtctgttgccaatgggatcagaatttatgttatgtatcaggatatgaagcttgcgtttgtgatcggtatcacgattattgcgattgtctgtatggcaaaggtggtgggatgcgtccttccgcttgttgcaaagaggatcgggcttgacccggcactgatggcgacgcctttgatctcgacgcttctggatacgggtacgatacttgtttattttgcgattgtaacgctgatgtttcgattgtgagttatagaaaaggggaattgtatcaaaaaagagacagattatctcttgtatacaatttccctttacgttataataatagtatctgagaaaaaatggaaaggagtcattaaatcatgggatttattgatgaaatcaagacaaaagccaaagccgatctcaagaccatcgtacttccggagacagaagacgtccggacttacgaggcggctgaggccattttaaaagaggggacagcaaagcttgttctgatcggaagcgaagaggaagtcgcaaaaaataaggggaatttcgatatcagcggagcacagattgtggatcccgcaaagagcgagaagacggagagctatatcgcgaagctggtagaattaagacagaagaagggtatgacagaggagcaggcaagagagcttcttctgacgaactacccgtactacggcgtgatgatggtgaagatgggggacgcggatggaatggtttccggtgcctgccactctacagccgataccttgcgtccgtgtttacagatcctgaagacgaaaccgggcaccaagctcgtatccgcattttttatcatggtagtgccggattgcgagatgggggagaatggtacattcgtattcggcgactgcggtctaaaccagaatccgagcccggaagagctggcagcaatcgcaatctcttccgcagagagttttaagcagcttgtaggggcagagccgagagttgcaatgctttctcattcttccatggggagcgcaaagcacgacgatgtgacaaaagttgtagaggcagtcaagatcgcaaaggcggaagcgccggatctgatgctggacggagagctccagttagacgctgcgattgttccttccgtaggggcatccaaggctccgcaaagtccggtagcaggaaaggccaatgttttgattttccctgacctggatgcgggaaacatcggctacaaattagtgcagaggctggcaaaggcagaagcttatggtccgatgacacagggaatcgcagccccggtcaacgacctctccaggggatgcagcgcaaaagatattgaaggtgttgttgccatcacggcagtacagtgccagtcaaagtagaaaggaagaaagaaaatgaaaattttagtaattaactgtggaagctcttcattaaaatatcagctcatcgacatggaaaatgagagcgttctcgcaaaaggactttgtgaaagaatcggaattgaagggtccaaactcactcacaaaccaacaggaaaagagaattacgcgatcgagacaccaatgggcgatcataaggttgccgtgcagcttgtactggacgctctgatggataaagaacacggcgtaattgaaagcacagaggagattacggcaatcggacatcgagttcttcatgcaggaacggtttacagcgatgcgacgttaatcaatgaagacgttaagaaagtcattcgtgactgctttgaccttggccctcttcacaacccggcgaacctgatcggaattgaggcatgtgaagcggcaatgccaggaaagccgaatgtagcggtatttgacactgcgtttggtatgaagattccggagaaagcagcaatgtatgcgatcccatatgagtattatgagaaatacagcatcagaaggtacggcttccatggtacaagccatatgttcgtatccggtgagacattaaagaaaatcggaaaagacgctgcgaaagtcatcgtatgccatcttggaaacggtgccagcatctccgcatccattggaggaaaatgtgtcgataccagcatgggactgacacctctggaaggtctgattatggggacaagaagcggtgacctggatccggctgttctgcagttcatctgcaaccatgagaatatcgatgtaaatgagatgcttaacatcctgaacaagaagtccggtgtccttggaatgagtggggtatcttccgacttccgcgatgtaagagaggcggctgacgcgggaaatgaacgtgcgattatggcactggatgcttacagataccgtgtggcgaaatatatcggttcctacacagcggcaatgaacggcgtggatgcgatcacatttacggctggcgtaggcgaaaatgatactcagatgagagaggaaatctgcgaatatctcggctacctgggtgtgaagatcgacagtgagaagaatgcgcaggctcgtggaaaagaagaagaaatctccacaccggattccaaagtcaaagtatatgtcattccgacaaatgaagagcttgcgatcgcacgcgagacaaaggctttggtataatctctttccttataaaaaactgttgacaaaaaaatgtgacatgatataatagtcaaggtatgaataggagcaatgaatatgctgttaaacctatccgacgtactgtccgaccagcacagtccgattgatgcggctgttccactggaaattaacacgatgaagctgccgggaggtccatatcccttggaggagaggagcaacgtacagattcatgtggagcatgtaaaagggaaagagatcgctgtctcgggaaattgcagtctgactgcggtgattccgtgtgaccgttgtctcagtccggtgagagttccgatggagatttcatttgagaagcgtgccattgtcggtggagaggctgaggagacagacgaagcatcagattatattgacggatatcatcttgacgtcgacaaattactctattatgagattttgataggatggccgacgaaaaccctgtgcagggaagactgcaaaggactttgcagtgtatgtggtcagaacctaaacgagggtacctgtgactgtgaagacacgggtcttgatccaagaatgtcagttatccgcgatctgtttaagaattttaaggaggtgtaaccgatgtcaatttgtccaaagaataaaacttccaaagcaagacgcgacaagagaagagcaaactggaaaatgagcgctccgaatcttgtaaaatgcagcaaatgcggcgcacttatgatgcctcacagagtttgcaaagcttgcggaagctacaacaagaaagaaatcattactgtagaagactaatgagaacaatgaaaaagggagtttgcaaatgcaagctccttttttcgtggggatttaccacacttcatcttcgcaataacaataacagtatcagcatccttataatttcccaatactgcgtcttcccgtgatttttccagtttctgtaataacatttcttcgtccataaatgcatatggatttcattctggtctcttgatttcaaatgggaatccgttattggcaactgcttgtgttaaaaacaatctgattgcagatgtagtaatagcaatccgagagttcagctattacacctccttgccgggaaactgagcataatatgagttccatatccccgttcactgataatctcaaagccattttcttccggatagaggatcgccagtcggtcacggacattggaaatgccgatccggttgccggttccggacgtagaagaagcatgtagaagcatcgccacctgctcttttgacatcccgtcgccggtatctgtaatatcacagtaaagcttccccttgttctgatagataaaaatatgaatgctcccgctcttcgtctgttgaaacgcatggaaaaacgcattttctacaagtggctgtaaaagaagattcggaatctccagattggcacagtccggcatagcgtctgcatcggcctggatcagtccaccgtatcggggtgagataatagaaatatagttccggatattctgcaattcatcagagaccgatacttttttgtttgttttattcaatgtacttcggaatagggagatcagagaatcgatcgtcctgcaagcttctgaagtatttttcatttctaccatatgtttgacactgtcaagtgtattatagagaaagtgtgggttgatctgcatctgcaggatactcagttcgtcctgtcgccgccgttcgtgtgcctcatctatctctttgacataagagttcagcgaagtaatcatctgattataggccgaagcgattccctggatctctgtggtatctgaggtgtcagacagaataataggatccggaatcccctttgcgtctttcatatgatttgccagagtgcgcagaggcagcagatttttccggatgatgaaaaaggaaagcagcatgagcagcagaagggccgtacagatcaccagaatggactggatccttggccagaactcgttgagcaggagggaggaagtaatctggctgacaatgtatgcatcgtaatatggaagataacgggataaaacaatccaactaccagaaagctcagagtactcacggtcccgcttctgattttccctggcagacaataataggctttggtttttttctccgatatcgtcagtcagattacttgataaaatcgtaccatctgaggagagaagaagaatactggtgctctgactgctgaagctctgatagaactgtctcagactctgttccggtataaggataaacagtgcgccgtacaacgagccgtcagagccggtcagtggcctgcatccgtagataacagggatatgctgtgtcaaaaaggtaaaaccttcttttcttccttcatatgcgatgcggtctgtgtggattgcggtctgcagcgcaggaagggtgagcagttccgaagacgggcaggtgacgccgccgtttccggaaccgacgacaattccatttgctcccactagaaccagctcataatcgaccatggcggctggcattccggagaagatccggctcagattctggcgagcctcccactcggctgtgatatcattaagatccgaggaaagagccctcccaagcaagggggtgttctggatttccacagcaatgccggaaatatggtcattgacaagactaaggctggtggcagtctggcttaaaatttccagattggaggaaacagcggcccgcttggtctggtggatgtaaatcctggatgaagtgaaggaggctgacagcaatagcaggatggtgaccgcaaagatcggcagcattaaatttaggaaaatggtttttgtacggtgcataaatgtcagtcctttctctggtattgattgcgaaactgcaggggggtcatacccacttgttttttaaatacttttccaaaataactctggtcagcatatccgatcgtttcactgatatagctaatgctgaaatttgtgacacttaaaagctctttcgcatggcggatacgtgtatcgttcagatgttcgctgaaatgtttccctgtttttctgctgatgtaggcagagagataggaatagttcatatggagattgtcagcaagatcatataggctgacctgctccatataatgctgttcaaggtagtcatccagttctgtaaagatcagatccggtgtctgggaaccggaacacagtacagtcagttccccataagcagatgtgacagcttcgcagaactgtgaaaaggtgaaaatgtagtctagctgtttaaaaagcttcaattcgacccgggagatttccgaaaaattctgtgcctggtttcttgcgtatctcagggagctgtaaaaggtatgctccacaaactttttaaaccggaatggattcattttcgtgctgtttttcagatccatcatataagcaagaatcaaatcgcaggcgtcctgccagcatccatgctcggcatagcaggtgtagcgctcctgctgaaatggaggggcggattcttcagaagaaagcagatcattttcaaaaaagcaaagctgattctcatataaaatagaataaccgcagagatccagaagcttttctgccctttcacgaaacaaggacagatcttgaaacggggcactgattacacagcttgtatgacgcagcctgaaagccatcaagttaagaagaggccggatgttcgcatcggaagaagagaaggcccagagcacgacggcatgattctgagtagtaaagcatgagagagccggtacgtcggtactgctacggtccagcatctgttgcagatcttcttcactttcaaaatccggtttgggagaagcgagaagagcgagacagtaatactgccctataagtcgtttcttaacataagatgagaaagagtccgaatccccatttgcatacccgtccagtacttttcttgccagaagtccgaaggttttttctgtttgaccggataggagcgactcctttgctgggcctaatcggttcagacattcaagcagagaatcttttgtcacccggttttttaaaagatagtcagaagccccgtattgaaaagcttccctcactttgtcaaattcattgaaattactgagcattacaatcggggctttggaatagcggcggagcattgcgacaaactggatgccgctgattcccggcatgacaacgtcgcagagtacgatatcgggctggagtttcagaaaaagttccagaccttcttttccgttcgaagcctctccggcgatcgtataattgtttgcttcccagtccatcatatatttcagaccctggcgaaagataaattcatcgtctataatcatcaaacgtctcatctggcacgctccttttcgcttttgtttttttgattataccatacgaaaaagattccaacatcaaatcactttgaaaaaatgccgactgccaaaatataacaaaataattcagaaaaagatcaaaaaataatcagaaaatgacagataccaaacaaaaagcaaaaataaatccgaaaaacaaagaaaaagattctataattttgtgcagaaagacgataatattttatctaaatacatggccatgggaaacaatgaaaccgacagaaaatacaggaggagagaagatgagaaagaaagtaatatctgctttattgatttcggcaatgatagccggtctttgtatgggatgtggaacttcttcatccggagatggagcgaaggattcctcagatggcaagaaaaaggttgtcgtctgggcgtgggatgtggaatacaatatcccggtgatggaagaagctgcaaaacgttatgaagaaaagcacagtgatgtcgacatcgaaataatggaatatgcatatgacgatattactcagaaactcaacacgaatctgagttccggtatcacagacggacttccgaatatcattttaagtgaggatgcaaatgtccagaagtacatccagtcctatccgggagaattcaaggatatgtcagatatcgtggatttttccaactttgcggaatacaaagtggaagttctgaccatggatgatggcgtatacggagtaccgtttgatatcgggacagaaggactgttttacaggaaagattatctggaacaggccggttacacgaaagaggatctgacggatatcacctgggatgagctgattgagatcggaaagaaagtcaaagaagtgaccggaaaagacctgatgacaatggatccgaacagtatgacgattatgcgtgattttatgcagtcctcgggaacctggtactttaaagaagacggagatctgaatatcgccgaaaatccggtgattgaggaaggatgccgtatttacaaagaactgatgaacagtggagtgatcaaacttacaaccggatggggagatatggcggctgccctgaataatggggatgtcgcttctatcgtgagcggatgctggattgtaccgaccatcaccgcacaggaagatcagtccggactctgggaagtgacaaggatgccacgcttaaatattgagcagggtacgaattatgggaatcgtggaggttccaactggcttgtcttggaacatgcaaagaacagtgatatcgcggcggactttttaaatgaaatctatgcaaacgatacagaattctatgagacgattctgactgaaatcggggcgattggcgcttatattccggcgcagtccagcgaagcgtataaggaaccggtagaatacttcagtggagaaccgatctgggctaactttgcggaatgggcaaagcacgttccaccgatttcggtcggagtctattctgacgaggtggattccacgcttgtgacgcagatggcaaatgtcctgaacgattccacgagtattccggatatgctgaaaacagtagaagaccttgtgaaatcacagatacagtaaactatgatttggagttggagtataagttatgaacaaaagatcatcaaaacaatggttccggcttgcaaacaatgggtgggcgtttgtgctcccatccattgtcctcttcctttggcttgtcttatggccgatgatcagcgcctttttgatgtcgctgcagaaaggaaaaggaacagtcgtagaatttgcgggactggataattacatccgcctgtttcaggacccggtatttatcagcagtacgatcaatacgattacatattttattatccaggttccggtcatgcttgtgttggcgttgattatttcttcgatcctgaataatccaaggctgaaattccgcggatttttccgtacagctattttcgtgccgtgcgtgacaagcctggtggcttattctttgctgttcaaaagcatgttcgcgacagacggtattatcaatcaggtgttggtgtcactacatatcgtaagtgaaccgattccttggcttttggagacattctgggccaaggtggtgattatttttgccatcacctggagatggaccggatacaatatgattttctatctgtccagtatgcagaatattgaccgcggggtttatgaagcggcagagatcgatggtgcaggggcatggcagaaattctggtatattaccgttccgttgctaaagccagtcatccttctgactgcgattatgtctacaacagggacgctacagttatttgacgaggtcgtgaacattacttccggcggaccggcaaacagtacgatgtcgatttcccagtatatttacaacctgtcctttaaatacgccccggattttggatacgcggcgactgtttcctatgcaatctttattatggttgcggtgctgtctttgattcagatgaaagtgagtggtgaccgaaatgacaactagacatacagaaatctatagtggaaaagcaaaaagaagagtaatttacggcgtccaatacctttttttgatcgttgtctccattgtctgtgtgttcccgtttctatggatgctgatcggggcgacaaacaaaagcatggatattacccttggaaagatgtctttggggaatcagttttttaacaatctgaaaaatcttctggaggcgggagatctgctgacatgcctgaaaaactctgcggttctcagtgtattcattacggttttgagtatgttgatctgctcttttgcgggttacggctttgtgatcttccagagcaaaaagaaggagttctttttctcattgattttgctgtccatgatgataccgacatcttctcttgtcattccgatgtttaagatgttcaacagtatgcatctgctcaacacaaaactaggagtggtgcttcctgctcttagtacggcatttttaattttctttttcaggcagaacacaaaaaactttccgctggagaccatccagtcggcccggattgacggtctgggagaattcgggatcttttttaagatttatatgccaatgatgaaatccacctatgcggcagcggccattatcacctttatgtcaagctggaacaactatatgtggccattaatttcgttacagaccaaagatcagagaacgcttccgcttctgatcagttccctaggaactgcgtacactccggattacggaatgattatggttggaatcatcatcacgaccatcccatcagcggctatttttttcctgatgcagaaaagttttgtcaacagtatgatgggatctgtcaagtaggatcagaaagaggaatgtgtatggaacgatcacagataaaacagcatctggcggatccggaattttttgcggagaaccggttacggccggtatcagatcatatgtggtatgagacggaaaaggaggcgctgaaaaaagaaaaaatgcgtcttcggatgagtttgggcggagcatggaaatttttctatgctccgaatccggatagtgtaccggatggatttgaaagaaaagactattcctgcgatggatggaataccatttctgtcccagcccatatggaattacaaggctatggacgtccccattatacggatacggactatccgtgggacgggatcgaggaggtcacgcctcacggcatcccgcagatctacaatccaacaggatgctatgtacggtatttttctatcccggagcagatgaaaaagaaaaagctactgcttacctttgagggagtggagacggcctttcactgctggattaacggtcactatgtaggatatggggaggatagctatacgccatcggtgtttgagattaccccgtttgtagaaaacggggaaaataaaattgcagtggaagtgtcgcgtttttcctctgggagctggctggaagatcaggatttctggaggatgggagggatcatgcgggatgtatctgtcactgcggttccggggcttcacattcgggatctggaggtaacggcctgtctggatgagaagatgacagagggaaaacttaaggtccggtttgatttggaaggagatccggcggtattgaaaagcagaaaagggaagattatctggaaacttttggatggaaagatccgcatggaacacaccgtatctgaagaaacagagaaaatcatgtccggagaattgctgatagaccgggaagatatccagatgacagtatgtgtgccggatgtaaagttatggagtgcggagagaccttatctgtatcggcttgtttttacggtgtatggcgaagagggagaaatctatgagagtgttccgcaggacgttggatttcggaaagtggagatccgggattcggtgttgctttttaacggcaggcgtctgcgtctatatggagtgaaccggcatgagttttctgccagaaaaggacgggcaatcgggaaagaggaaatggagtgggatatccggtttttgaagaggaaccatttcaacgccgtgcggacgagccactatccaaatcagagttactggtatgaactgtgcgaccgctttggcatctatgtgatggatgagacgaacctggaaactcatggtacctggcatctgaaacaatttaaccacacgctgccaggggacaatccccggtggcatgaagcagtgatgagccgagcccgtgcgatgctggaacgggacaaaaatcatccttgtatcttctcctggagtgtagggaatgaatcctggagcggaaaaaacctgtatgagatgagtatgtatttcaggaaaagagatgacagccggccggttcattacgaaaatgtatgccatgaccgcagatggggtaggacaacagattttgagagcaggatgtacgcctcgcctgaggaagcagaagcgtatctgaaagatcatccggaaaagccgtaccttttgtgcgagtattctcatgccatgggaaactcctgcggaaatctgcgggagtacatggaactatttgacaaatatccgcagtacagcggaggatttctatgggattacattgaccaagcactgtaccagacaggaccaaacggcaaggaatatctggcctacggaggcgattttggagatcgcccgaccaattataatttctgcgggaatggtgtaatcttcgcggatcggaccatctctccgaagatgcaggaggtgtcgtatctgtatcagccttataaacttacgccttcagagacaggagttaccatccgaagtttacagctttttgagaacggagagtattaccgaatcgtctggcggctggaaaaagaaggaagggtattaaaatccggagaagcgcctcttgtgatcgaaccggagagtacggttttcgtagaggcggacctttcgattccagaaaaggcagaggcaggagaatatgtcagaacagcagctcttgtcatggagagagacactccttatgtgaaacgtggggaggaaatctgcttcggtcagaccacagaacaaaaagaagagaaaggcaaaagagaagaaaacaagcatcctctgcttcggacagtggatggcgatagttctttttccgtagtgggagcggattttcggattactttccagaaagcgactggaaaactggtctcctggaaaatcggggagaaagagctggtgtatgatccggtacatacgctgtcaccggaattctggagagcgccgacagataacgatgaaggatatcgcatgacggagaaatgtcatttctggaagatggcgtctttgtatccgaaagtaaaagaggtcacgtgcggtacgatagaccatcatgcggtgatcgataccatctatacgctgggagaaaccgctcagtgcagattacggatacagattgacggagaagggaatatggatgtgacagagtcgtatactggtatggaaaatcttcctgatctgccatgttttggcgtttcctggaaactgccgaaagcgttttcccacatcacatggtatggaaaaggacctcaggaaacctatcgggatcgtcaggctggaggaagactggggcggtttgaaacaacttctgctttaagctgtacgccgtatctgattccgcaggaatgtgggaatcatgtggagacgaggtgggtagccctgacagactcttccgacacagggatccgggtggagagtgcggtgccttttgaattttccgttcttccttatacttgtcacgagctggagggagccagacactggtttgagcttccgaaaccgtatgcatctgttctgaggattctggagcagcagaccggggtaggaggagacaatagttggggagcgtgggcacataaaccttataggttaagcggggaagaaaccaggacgttctccttttccatacggatgctccaaaatggcagaactgcataaagaagtccttgtccctccctcttttctatgttaagatgaaatgaaaccaacgaaaagaggcgcatgacaatgtggaatatggaaaaagtgactctggtgacaaataatgacagagtctatgaaaaatatagagaggatatggaagtgctgcttctggactcctacagggacgttcttttgaaagtccgggatctggtctatgaccgtcatatcctactgactcatccgcaggcatccagcctaaagccgaatcagacgccatatcggtccatcatggtatatccgaaaggggaagaggacaatatgaaagatatcatgctgatcgaaaaatgcattgagacatatgaccagtggcaggagatcgcggccacaccgcacaactatcagaaatcagtagcggaagatttcaagacgatcgacctgtctgtgattgagaatatcgtgccaaggctgatgtaaaggcaggcgacaggtatggaggaaaggaaaaaatattttaagggactgacgagaagggattatattgccaaggcaaatgagatcatccaccgggagggaatcgaggcagtgactattcggtggatcgcaaaggagatgggatgctcaacagcgagcctgtaccggtattttgacagccgggatgaactactgtattatgcggaattaggtgagatgaatgactatatccgacggctcaatgcggcagaaaagcattggaggaatgtgtgggatatctatgttggggtgtggtattgctactctatggaggcattccggaaaccggaagcatataatctgttattttttgccaacaataacacgaagctgagggtttctatccgggagtactatcagatgtttcctgaaaatctggagctgtccaaccgggtttttcatgagatgctccagacagcggacttcatggggcgtgattttgaaatgtgcagaaaatgtatccgttccaatgccattgggtatgaaaatgcggtatctctcaatcggatggtctgtcttttgttcaaaggatattttaaaacagtctgcgatgatggaatcaaagaagaggaagtaaatgcaagagtacgtcagtttattcgtgatattgaggatctggttcgaatgctggcaaaggatctgaaagggtataaagcgtatcaaatttaacgaagagcaggtttcgggaaagcaataacagaccggaatctgctcttttttggcggaattgctgtacttatagaagttatcgaaaaaatgtatagataaaatgtataaaaaagcttgataattgtaagacaacagcatataatggacataaagaacatgaaaaaagataacaaagtttttttttgacttaatgttatcgcgattacaaagaaggagggatttacctatgaaattggaattaggtaagattaagatcgacgatatccaatttgcagaaaagacatatgtgaaagatcatgtgctctatgtcaataaggaagaagtggaagagcttgttctggaagacgacaaattaattggatgtagcctcgacatcgcgcgtccgggagacagcacccgcatcacccctgtgaaggatgtcattgaaccaagagtaaaagtatcgggcggagagatattcccaggagttgttggaaaagtaacgccgtcagtcggagaaggaagaacgcatgcgctggacggatgctgcgttgttaccgttggacggattgtcggattccaggaaggtgtcattgacatgagcgggcctgcagcggattattgcccgttttccaagaccgtaaatctctgtgtagtaatcgaacctcaggaaggacttgagacacacgtatatgagaaagccggaagaatggcaggactgaaagttgcggcatacctcggagaggccggaagaaatgtagagccggatactttggagacattcgagacaaagccgattttcgagcaggcagcaatgtacccggatctcccgaaggttggatatatccacatgcttcagtctcaggggcttctccacgatacatattattatggtgttgacgcaaaacagtttgttcctacatttatgtacccgaccgaaattatggacggtgcgatcgtttccggtaactgtgtagccccatgtgataaggttacgacataccaccacttccacaatccggtgattgaggactgctacaaacaccatggaaaagatatcaactttatgggcgtaatccttaccaatgagaacgtattccttgccgacaaagagagacactccgacatggtagcaaagctggcagagtggatgggactggacggcgtgctgatcacagaagaaggctatggaaatccggatactgacctgatgatgaactgtcggaaagttgagaagaagggcgtcaaagtcgttctgattacagacgagttcccaggcaaagacggaaaatcccagtcacttgcagatacctgcgatgaagcagacgcacttgcttcctgcggacagggaaacgcaacattacagttcccggtaatggataaggtcatcggtacgatggattatatcgaaagccagatcggcggatgggcaggatgtgtcaatgaggatggttcctttgaagcagagcttcagattatcatcgcttctacgattgcaaatggcttcaaccaccttgcggcaaaaggatattaatatttggaaggaggaaccaacatggcaaaatataaaattgttcattatattaaccagttctttgccggcattggcggtgaggaaaaggcagattacaaaccggaagtaagagaagaagcactcggaccaggcgcggctcttgcacaggctcttggtgaggattacgagatcgtagctaccgtgatctgcggtgacaactatttcggtgaaaacctggatgaagcgacagatacgattatcgatatggtaaagaaatatgaaccggatgtattttttgcaggacctgcattcaatgccggacgttacggtgttgcctgcggtacgatctgtaaagctgtggaagagagacttggtattccggtgctgacagcagcatatgaggagaaccctggtgttgatatgttccgtaaggacgtgatcacagtgaagacaggaaattctgccgctacgatgagaaaagtcctaccttccatcgtcaatctgattcaaaagatggctacaggagcagagatccttggacctgcggaggagaactatcacgaaagaggaatccgtgtcaactactttgcggaagagagaggatccgctcgtgcgattaagatgctcgttaagaagatgaaaggtgaaccgtttgagacagaccttccgatgccgaagttcgacagggtaccgcctgcaccggcgatcaaagatatcaaacacgcaaagatcgctgttgttacatccggtggagttgttccggtaggaaacccggatcatattgagtcttccaacgcgacgaagtacggtgtgtactctatcgaaggaatggacgccctgtctccggacgatttcacaacaatccacggtggatacgaccgtcagttcgtcatggcgaatccgaacctggttgttccgcttgatgtactgcgcgaaatggaaaaagacggagagttcggtgaacttgtaaacttcttctgtacaacaaccggaaccggaacagctaccggatccgctgcaaaatttggagatgagattggtaagatcctcacagaacaggagcatgttgacggcgttatccttgtcagcacatgaggtacctgtactcgttgcggcgcaacgatggtaaaaggaatcgaaaaatatggggttcctgtcgtacatatggcgacggttgttccgatttcccttacaattggagcaaacagaattattccgggcgttggtattccgtatccgctgggtgatcctactcagggcgaagtggattccaagaagatccgtaagagaatggttcgtcgtgcattaaaagcacttcagacagaagtagacggtcagactgtatttgaaaaagataacttctaaataaacaacagacaggaaattgtgggtacggtgcatctgtactgtacccacattgaatttataaggataggaggggactctatgggcaaagaaagcggtgcggtgaactggaagagagttctgattctggctggagccgtgattgcgtttacaatcggttccgggtttgcaaccggacaggaaattattcagtattttacagcctatggctggcagtccattttggttattcttggatttgcggttgcatttttgtattacaatttcaactttgcaaaagcaggtgcggagcagcattttgaacatgggaacgacgtgtacaaatatttttgcggaaaatacgtaggtacattctgcgattactattccacggttttttgttatatgtcattttgggtaatgatcggaggagcggcatccacactgcaccaggagtacggacttcctacctgggcaggcgcagtgattctgaccatcctgacgaccatcaccgtaatcggcggactgaattctctcgttgacgccatcggtgtggtgggaccaatcatcgttgtcctttgtatctttattggtcttgttacctgtatccaagatggcggcaatgtcgctgctggtcttgatgtgatcaagaacagcgcctatgcgggagcagaaggtggagagacgatcaagaacgcaggagcaaactggtttatttctgctgcatcctacgctggattcgttcttttgtggtttgcaagcttcacggcagctcttggttctaagaacaagaaaaaagatctcaattacggtattatcggcggaaccgttgcagtatgtgtggcgattggtttgatttcctttgctcagatcgcaaatatcaacactccgctttcaggcagcgacagcacctttgtatggaatgcggatattccgaacctgatccttgccatgaagatctggaaaccgttctcagcgatctttgcaattgttgtatttgccggtatttatacgacagcggttccgttgctttacaatccggcatcccgcttcgcaaaagagggaacgtcaaaattccgtatcctgactgtgattcttgcggttgtcggattgattgtcggtctgttccttccgttcagaacactggttaatgtgatctatgttatcaacggatatgtaggagcgattttgattctctttatgctaaagaagaatattacggatctgttgaaaaagaagaaaaaggcttaaggaagaagataaaaaacagcaaccattatggttgctgttttttctgggaaaataacgaaaaatcttttagaaaaaggatgaaaaagcacgcgttttttgctaaaatatgagaggattcaagaagaaaaaaggaagtggagtgaggtaggaggatgaattatcacagaatcattgaaggaatcctggatattggagaggaaatgctaaaaagcggagcggagaattatcggctggaggatgccctctatcgaatgttgaaaagttatggctttatcagatacgatgtgtttgtcattccgagcaatattcaggtttcggccaagacgccggaaggagagttaatcacgcagatacggcatatcgagtcatttgagaatgattttgacagactggatcatttgaacgatctttccagatatgtatgcgcccataagccggatgcggatcatctcaaggctaaatttgacaaagtcatcagcctcccggagcagccggagattctgcgctatgtagctggagttatggggggtgctggatttgccgtattttttggaagtggatttgcagatgcgatcgtagcagttattgtttctttaatgattgtgtttgtcggaaaatggctgagtatgagggaaggcaacttgatgatctataacttaattcttgcatttctctcggaggtcattattatcctggcaacacgaaacgggatcggaactcacccggatcggattatgatcggaatcgtcatgcttttgattagtggtcttggcacaacgaatggtttccgagaactcttacagagagatttcatttcaggatccattaatattctgaattctattttaggagctacgggaattgcactcggaatcgctcttgcaatgctgctttttcacgagcggctggaagaaggatttatgctgaccccaagcattccgatgcagcttatctcctgtacgattgcgtgtattgggtttgccatgtggtttaaggtacgggggagaaaagttttttattccggagtaggagcttttattacatggggaatttatgctttgatttatgagattgaaccgagcaatttcctggccacgctgattgcggctgtctttgttggattttacgcatttatcatgtcaagagttaataaagcgccgtcaacgatctttctgacggcatctgtattcccgttgattccaggaccgaacctatactatatgatgtatggatttgtcagcaatgattcagctctgatatccagcgaaggggtgctgctcgcgactacgtgtcttgcgattgcatttggattcaatatcgtggatgttgtatccagggtcataatgagcacattaaaacgggaatttcgtgtaactaagaactcataaacacgaaggttatcagaaaagcattgatttttataacaatgtctagtagaattactggtagaatgctaggaggtagaagcatggcggaatacacaaaagtggcgcttgatgccatgggaggggattatgccccggcagagatcatcaaaggtgcggtggacgcggtcaataaacgtaaggatatccgtgtggtggttgtcggaaaagaggatatcataaaggcagaacttgcgaaatatacttacgacaaagaacagatcgagatcagaaacgccagcgaggtgattgagacagcggagccgccggtgatggcgatccgggaaaagagggattcatcgcttgtcgtcgggatgaatatggttaggcagaaagaagcggacgcccttgtgtccgcaggaagttccggagctatccttgtgggaggccaggtgatcgtgggaaggatcaaaggagtagaacggccgccgcttgcaccgcttttacctacgaagaaaggattttctctgttgattgactgcggagcaaatgtggatgccagaccatctcatctggttcagtttgcgaagatgggctcgatctatatggagaacgtcatgggtgtgaagaatccgaaggttgcgattgtcaatattggagccgaagaggagaagggtaacgcacttgtgaaggagacgttcccgatgctgaaggcatgcccggagattcatttcaccgggagcattgaggcgcgtaatattccatatggagacgcggatgttgttgtctgcgaagcttttgcgggaaatatcattttgaagctttatgagggcgtgggaggcgtactcgttgataagatcaaagaaggcatgatgaagagtcttcggacaaagatcggggcacttcttgtaaagccggcactgaaagagacgatgaagggatttgacgcaggggaatacggaggagcgccgcttctgggactgaatggtctggtagtaaagacacacggcaattccaaagcacgtgaggtctgcaattccattatccagtgtgtgacattcaaagagcagaagatcaatgagaagatcagagacagcattcagaaagagaaagaataaactttttaaggaaggaatgtaactatggaatttgaaaaattgcaggggattatcgcagatgtattaaatgtggacgcctcagacattacaatggagaccacgtttgttgacgatttgggagcagattctttggacattttccagattatcatgggaattgaagaagagttcgatatcgagatcgataacgatgacgctgagaagatcgtgacagtgggagatgcggtagagcagatcagaacggcagcaaataactaaaacatatatgcggaaaagcccgtgagggctttttcgtgttaattgggggttttatgagaaaaatcagagaactggaagagaaaatcggatactgttttcaggatcaggaactgctaaaacatgcattgcgccacagttcctatgtcaatgaaaaacatatgaaaaagcatgaatgtaatgaaaggctggagtttttgggagatgcggttctggaggtggtatccagcgaatttttattctttgagcatcagacgatgccggaaggagagcttacaaagaagcgggcaagtatggtctgcgagcctgctcttgcgttctgcgccagagatattgatctgggagaatatctgcttcttggaaagggcgaagaggcgaccggaggaagaaagagagattctgtcacatcagacgccatggaggcgttgattggggcgatttatctggatggtgggtttgctagtgcgaaagagtttatacaccggttcattttaaatgatctggaaaataaaaagctcttttttgatagcaagactatcctgcaggaaatcgtgcagggaagttccgatgagcacgtttcctacgagctgatccgggaagaaggaccggatcacaataagacattctgcacagcggtcaggatcgggggccgcacctacggcgaaggggaaggacggacaaagaaggcgtccgagcagcaggctgcgtaccaggcgattttgagattacaggagaaacagtaggagcgctatgtatttaaaaagcattgaagtacaaggatttaagtcatttgccaatcgtattgtctttcagtttcataatggaattaccggtatcgtaggaccaaacggcagtggaaagagtaatgtggcggatgcggtgcgctgggtacttggtgagcaaagggcaaagcagctccggggcggcaatatgcaggatgttattttctccgggacggagaaccgaaagccactaagttatgcatcggtaggaatcacactggataactccgatcacaaacttccggttgattttgaagaagtgacggtgacgagaaaactttaccgatccggggagtcagagtacctgatgaatgggagaagctgcagactcaaggatatcaatgagcttttctatgataccggaatcgggaaagaaggctactccatcatcggccaggggcagattgataaaatattaagcggaaagccagaagagcgaagagagctctttgatgaggcggccgggattgtaaaatttaagaggagaaagaatacttctctgaaaaagctggaagaagagcagcagaatctggtccgtgtgacagacattctctcggagttggaaaagcagtacgggccgctcaagaaacagtctgagacggccagggaatatctgaaaaagaaggaagagctgaaaaagctggatatcaatctttttcttgtacagacggagacgttacgggctcaggaaaaagagacgctggaagcgctttcaagagccgaggaagagctggcggagacaaagaagcagtatgaagccatgaaagaagaatacgctgaagtggaaggccgtatcgaggagatcgatcttgcgatggagactgccacaaagcagttaaacgatacgaagctgattcgacagcagtacgaaaaccggattgatctgctaaaagagcagatcaaaagtgtccggacgagcgacgcccattacgtggagcgaaaagagaccgtagaggcggagattcagaagcgggagggagagcttcgcgatctgaaagctcagcgggaggatttggaagatcagatgcgggaaaaggaagcccagagcgagtcagagaggaaaacgcttaccaatctccaggaagagatggcaagaatcagtctctctacagaggagaagaaaaatgagatcatgcagattctctccggacgtgcttccacaaaagcacggctacagcattttcacaccttacgggagcagcttcgtgtacagaaggcggagcttgccaagcagcttctggcgattacccaggagacagaggtgtaccggacggattatgagaaatacgaaagtgaatggaagacattgtctcaggagattcgtacctgtcaggagacgattgccggatatgaaagcgagatcaaccgtcttcagcaggaaatcacccgagaaaatgaacagatccgaatcggacagagcgcttaccaccgagagcagtcccggctggaatcgctgaaaaatatgacggaacggtacgaaggatacggaaatagtatccgccgggtgatggagcaaaagagccgggagacgggaattttaggtgttgtggcagatctgatccgtgtggataaaagatatgagacggcggtagagacggctcttggaggcaatatacagaatattgtgacaaaagatgaggagacagccaagcggatgatttcctttctgaaacaacataaatttgggcgggcgacgtttctcccgctgacaagtgtccggggatcggagtttctaaagccggagattctggaagaagatggcgtcatcggactggctcacacgttggttgagacggacaggcagttccatgatctgatgaagaacctgctgggacgtactgttgtcgtaaaaaatattgacgtgggaatctatctggcgaggaaataccgccagagtgtaaggatggtgacgccggagggcgagctgttaaatccgggtggatctatgacaggtggagcctttaagaattccagcagccttttaagcagacgtcgggagatcgaggagtttgaaaagacggtgcagatgttaaagaaagatctggatgaggcgatcgcttctttggagacccataagcaggaacgtgccggatactatacaaagatggatgcactcaaagaagagatgcagaaaatctatgtccggcagaatacagccaggatgaatctttcccaggtgcagagccgccagaagaccattacggagcggaaatccgtccttcttcatgaaaatgaaggactggagagccaattaagggaacttcaggagaatcaggactcgattgagattgaacttggcacttcggaagaactggagaagaagttaaagtgggagaccgaggaagaacagagggtactggaggagaaaaaagaacaagaacagattctgcaaaagagggcggaggaagcgcatcttctgtttgtggagctgggacaaaaagaaaacttcctaaatgaaaaccaggatcgtattttacaggaatatacgaaatacatacaggaaaagaagttgttggaggacaaccagggagacaacaagcgggagattggagaaaaagagcaggagatggggctggcaaggcagaaaatagagaatgccggggagctgatcgaagagattgaacaggaattacaggaaagcgcaaaggagaaagaagcgctctccagacgacataaggaatttctgagtaaacgggacgtcatttctgagacgatgtccgatctggataaagaggcgtttcgtctcggaggtaagcgggacagcctatctgagacgatggaaaagcagatgaattatatgtgggaggaatacgagatcacatataatcatgcacttcagtatcgggaagaagagccgggggatcttttgtttatgaaaaaggagatccagagaatccgctctgagatccgcacccttggcaatgtcaatgtcaatgctattgaggattttaaaaatctggaggaacgctatgagttcttaaagaaccagcatgaggatctcattgaagcggaagtgacattaaagcagattattgaagaattggatactgctatgaggagacagtttgaagaggagttcgcaaagatcaaagaagaattcaacagtgtattcaagcagttgttcggtggagggaaaggaacacttgagcttctggaggatgaggatatcctggaggccgggatccgtattatcgcccagccaccgggaaagaagcttcagaacatgatgcagctttccggaggagagaaggcattgactgcgatcgcgctgctgtttgcgattcagaacttaaagccgtcaccgttctgtctgctggatgagatagaggcggctcttgacgactccaatgtcacaaggtttgctcagtacctccacaagctgacaaagaatacccagtttatcgttattacccatagaaggggaacaatgacagcggcggacagactgtatggaatcaccatgcaggagaagggagtatcgacccttgtttcagttgatcttttggaaaaccagcttagtaaataaagaataaaggagtgaaagagatatggcagaggagaagaaaggattctttcggcgtctggtatctggtctgacaaagacaaggcagaatattgtatctggtctggacagcctgttccatggtttctcaagtattgatgaagagttttatgaggaactggaagaaattcttatcatgggagatcttggagtcaaagcaacgtatgcgattctcgatgatcttagagagaaggtaaaggaacagcacatcaaggagccagccgactgcaagcagcttctgattgacagtatcaaagcccagatgcagatcggggagacggcctatgagtttgaaaatcggaaatccgttgtgcttgtgattggtgtcaacggagttggaaagaccactaccatcggaaagcttgcgggcaagcttcgaagtgatgggaaaaaggttgtgattgcggcggcggatacattccgtgcggcagcgggtgaccagcttaaagagtgggcagatcgggctaatgccgaatttatagggggacaggaaggctcagatccggcggccgtcgtttacgatgcggtggctgccgcaaaagcgaggaaggcagatgtgctgctctgtgataccgcaggacgtcttcacaataaaaagaatctgatggaagagctgaaaaaaatcaatcgtgtcattgagagagaatatccggacgcataccgggagactctggtcgttctggatgggacgacaggacaaaatgcactgtctcaggcaaaacagtttgcggaggcagcggagattacaggaattgtactgacaaagatggacgggaccgcaaaagggggaattgtggttgccattcagtccgaacttggaattccggtaaaatatatcggagttggcgagacgatcgacgacttgcagaagtttgatccggatgattttgtaaacgccttgtttacagcggattcacatgaggaagatggggaagaagagtaaaaggaaacagtgacacggaaggaaagaaggttacagcgatgatgacattggaaaaatttgaagaagcaagtgagcttgtcaaaaaagtgacaaatccgacaaagcttgtgtacagtgagtatttaagtgaagagactggaggcaagatctatttaaaaccggaaaatatgcaacatacaggcgcatataagattcggggtgcatattataagatcagtaccctcaccgaagaagagaaggcaaagggactgattaccgcatccgcggggaatcatgcacagggcgtagcctacgcagcaaagctatttggatgcaaggcgacgattgtcatgccgacagttactccgctgattaaggtgaatcgcacgaagaatctgggggcagatgtcgtactttatggcgatgtatatgacgatgcctgcaacagagcttatgatctggcagaagagcatggctatacgtttgttcatccgttcgatgatctggaggtagccaccggacagggaagtattgctatggagattgtgcaggaacttccaacagtggactatatcattgtaccggtaggtggaggcgggctcgtcgcgggagtatccacccttgccaagatgctcaatcccaagattaaggtgatcggcgtagagccgtctgaagcggccagcatgaaagctgctctcaaagcaggagagccggttacacttccgagcgcaaatacgattgcagatggtactgcagtaaaacgggtaggaagcttgacatttgagtacgcaaagaaaaatgtggatcagattctgacggtggatgatgatgaactcatcggtgctttcctcgacatggtggagaatcacaagatggtggtagaaaattccggtcttctttctgttgcggcactgcgtcaattagatttgaaagggaaaaaggcagtctgcattttaagcggtggaaatatggatgtcatcaccatggcttctatcgtacagcatggtctgatccagagagaccggatcttctctgtctccgtcctgcttccggataagccgggtgagctcgtacgggtggcaaagacgattgcagacgcccagggcaatgtcattaaactggagcataatcagtttgtcagcacaaaccggaatgcggcagtagaactgagggtgacgatggaagcattcggaaccgagcataaacatcagattttggaagcgttggaaaacaatggattccgtccgaagcttgttacgacaaaactgtattaagatgggactgtaaaagaaaattgtaaaaggagggaacgccgtggaaaacttacggccggaggaaggtggaatttaccacagcctgtcaggaactgtctatcggtatcttggcatggcaagacactgccagaccggagaggagcttctgatctttcaggagaaggagacgcaaattttgcaggcagtgacggtaccttattttacaaaagagtttcagaaagctggagaggatccggaacaagggcttctttatgcttttctgaatgcggactccaatgaagagaagctgattctgctgcagcagaatcgctcggaaatgacagaggcagtactggaaacagtggcgcagagtctggattatacgcttgacagcagcgatccggacagaatgtttttggatctggaacagtgtcttagaacaaaaatcaaatatgagcgcagaagaatataaagagcttcccaccgggcggtcatatgaccggatctttggtggggagttttttcacgtcttattggagaaatgttatattctgggttgacacattttgtataattgtatacaattatacaaaatgaaaaggagtgaaggaaatggataatagaaaagtttacatgaactaccataataatttattgcagctcgaagaacatatgtatccattggtggatgttgatacgccgaacgtattccggaatctttttccttatgatgaggttccgaagattgcgtttaacgaccgtattgtgccacattccatgccggatgagatctggatcaccgatacgacatttcgggatggacagcagtcccgtgcaccgtatacgacggagcagatcgtgacgatctataattatctgcacagacttggcggcccggaagggaagatccgccaaagcgagtttttcttatatagtaaaaaggacagagacgctgtctatcagtgtttagagaagggctatcaatttccggaagtgacaagctggatccgcgcaagcaaaaaggactttgagcttgtcaaagagatcggtctcaaggagacaggaattcttgtaagctgttctgattatcatattttctataagctgaaaatgacaagacgagaggcgttgcggcattatctttccattgtccgggactgcctggaaatcgggatcagtccacggtgccacctggaagatatcaccagatcggacatttatggatttgtgataccgttttgcctggagctgatgaatctgatgggagagtacaggattccgattaagatccgtgtctgcgatacgatgggatatggcgtcaactatcccggagcggtgatccctcggtctattccgggtatcatctacggtttgatggttcatgcaggggtgccgagcgaactcattgaatttcatggccacaatgacttctacaaggcagtcagcaatgccacgacagcatggctctatggtgcctgcggcgtgaactgttccctttttgggatcggagagcgtaccggcaatacaccgctggaagcaatggtctttgaatatgcacagctccgtggcagtcttgacggtatggacacgaccgtcattacggaacttgctgagtactatgaaaaggagatcggctatcatattccggagcacaccccgtttgtcggcaagaacttcaatgtgacgagggctggtatccatgcggacggacttctgaaaaatgaggagatttacaatatttttgatacgggtaagttcctgaaccgtccggctgtggtctctgtgtccaatacatcgggaattgcgggtattgcacactggatcaatacatattataaacttccggatgagcggaaagtaggaaaggattccgaacttgtcgcagcggttaaaatgtgggtggatgagcagtatgacgacggccgtgtgactgtaatgacagatgaagagatggtgcagaagatcactgaaatctgccgggaaaaggaaatcattttatgacgaagaaaggaagcgtgatggaaacgagtcaggactattcgctaagcggaaaggtctttcgtacattgagcgagcagatcctttccggaaaatatcaaacaggcgatgagcttcgagaagtgactgtaggaaaggagcttggcgtgagcagaactccggttcgggaagcgtttcggaaactggaactggaggggctggtgacaagcatcccgaataaagggacctatgtcaacggtatttccagggatgacgtgcaggatatctatatgatccggtccaggctggaagggctggctgcacggctagccaccagaagaattacaccggagcagatcaatgagatggaggagatgatttttttatcagagttttatcttaaaaaggggatgacagaacagctctccaatctggacggcaaatttcattttattttgtacgaggcctgcggcagcaggatgctgaaaaatgtgctgacggattttcaccgttatgtgcagatggcaaggcggatgtctgtcaaggtggaaaacagggcggaaaaatcaattcgggagcactcgcagatcttggcggcaattcgggatcaggatgaggacagggcagagcggctgatggaagagcacattcatcacgttgttttaaatctgcacctggaagaaatttagaaaagaaagggatggtatgaatggcaaagatacagatgcagacaccaatcgtggagatggatggagatgagatgacaaggattctttggaagatgatcaaggatcaccttcttcttccgtttcttgatctgaatacaaaatactatgacctggggcttgagtaccgcaatgaaacgaatgatcaggtgacgatcgacagcgctgaggcgacaaagaaatacaaggtggcagtaaagtgcgcgacgattacgccaaatgcggcccggatgaaagagtacgacttaaaagaaatgtggaagagtccgaacggtacgatccgtgcgattctggatggtacggttttccgtgctccgattgttgtaaaaggaatggagccgtgcgtgaaaaactggaaaaaaccgatcacaatcgcaagacatgcctacggcgatgtctataaagggacagaaatgaagattccgggaagaggcaaggcagagcttgtctatacagcggaagacggaagcgaggcaagagagctgatccatacctttgacagccctggtattatccaggggatgcacaacttaaacggttccatcgcaagctttgcgagaagctgcttccattatgcgttagatacgaagcaggatctgtggtttgcgacaaaggatacgatttccaagaagtatgaccatacattcaaggatatttttcaggaaatttttgatgcggaattcaaagatcagtttgaacaggcaggcatcacttatttttatacactgatcgatgatgcagtagctcgtgtgatgaaatctgagggaggatatatctgggcatgtaaaaattatgatggggatgtaatgagtgatatgatttcctcagcgttcggttctcttgccatgatgacgtcagtactcgtatctccggacggatactacgagtatgaggcggctcatggaacggtacagagacattattacaaacatctgaaaggagaggagacgtccaccaactctgtggctacgatttttgcctggagcggagcattaagaaagcgcggtgaactggacgggaacaagggacttcaggattttgcggaccgtttggaacaggctaccatcgatacgatcgaggcgggagaaatgacaaaggatctggcgctgattaccactatcccggatccggtcgtattaaacagcgaggatttcatcaaagccatcgcaaagagactgacagaatagtactgccttgatgtatcattatgagcaataagcaaactagaactggagcatgtgtttgcgtttgataaaagctctatccaatataggcgaacaaaaaacaggcgggatcaaattgaccccgccttagctacgtttctatgtttgtttatcaattttccggatcctcggcgagtgtttcccactgctcataaagagtctccagtcttgctgtaatttcatctttttcttttgcgagctcctggcagcggacggaattggagtagacatcttcccgggtcatcagatgatcgatctcctcgcttcgtccttccagcttttcgatcgtttcctctgtacgccgcagatcattctgtcgtttccgttctcttgcctgtgcctccttctgggctttccagtccagtttcccggaggataaaggagtttccttttcggccgtggcctccggggcaggagcagcatagacggctgtaagctcctcttttttctccagatagtaatcatagtttccaatgtagttgacgaacttctgattgaccagctccaggattcgtgtggcagtcctattaatgaagtaccggtcgtgggagacatagagcacagtcccggtgtaatcgttcagcgcgtgttccagaatctccttggacgccatgtccaggtggttggtcggctcgtcgaggatgagaaaatttgcttcagaaagcatgagctttgccagggagaccctgcccctctctccaccgcttaaatccccgatcagtttgtagacgtcgtcaccggtaaaaagaaatgcggccagcatattgcggatttgggtgttggtaagatgaggataatcatccgagatctcatcgaacaccgtcttgtccatgtgcaggacatggtgctcctgatcataatagcctaccgtaacgttagaaccaagggtaaacgtcccgctgtctgcaggcagtacttcatttaagatttttaaaagcgttgtcttaccggtgccgttatctccgatgatggcaacatgttctccacgtttgagttcaaagctgatatcttcaaagagtgtctgttccggaaaggatttgcttagatggctgacacttaggacgtcattaccactgatgatggagggctccagctttaagtgcatatcggttttcagttccatcggtttttcgatccggtcgatttttgcaagcatcttttcccggctttccgcccttttaatggatttttcccggttaaaagagcggagcttttcaatcacggcctcctggtggcagatttcctgctgctgattgagatattctttcagtcttgcatcccgtaacatctgctttttctgggcgaaatcctgataattgccaagatacatggtaagggttccggcctcgatctcgataatctttgtaacgacccgatttaagaaatatcggtcgtgggagacgatcagaacggcgcccggatagttcaggagataagtctcaagccaggtgatagagtttaagtccaggtggttggtgggctcgtcaagaagaaggatatccggctttgtcagaagaagtttgccaagtgagacacgggttctctggcccccggaaagggaggagaccggctttaaaaattcttcctctgtaaagccgagcccctttaacactccggtgatttcgctttcataagcatatccgttttctcgttcaaaccgggacgtcatcttgtgataagaggagagcttttctgtcagagcgtcaccgcttaaagactcaagttccgcctctgtctttcggatctggttttccagatccacaagatactgtctggatgtgcggagttcctcatagatagtccgggtactgtctgtcatcgggtgctgagaaagatagccaatctgctttccttttgcaagaataatctcaccggaatcggatggaagctccccggtgatcatctttaagattgttgattttccggcgccgtttaaccctgtcagcgccgctttttcgtggtcttctatatgaaaagagccatgtcgtacaatgacctggtctccaaatgatttttccagattgtgacatgcaagtatcataaaatcctcctttgataaaccaaaagttccgtattcattataacggaatttatacaaaatacaacataaaatcccatgaaaagtttgactttatatcaggttttacatataataaggatattgagaagaacaggaaggtgcaggaagtggaaggaaaaggaatttctcaggcagtcatccgaagactgcctcgatactacagatacttaggagagttactggaagacggtgtagagcgcatttcctccaacgacttgagcaagcgcatgaaagtcaccgcttcccagattcgtcaggatttgaataatttcggcggtttcgggcagcaggggtatggatacaatgtgaagtatttacattcggagataggaaagattctgggactggacagagagcacaatatgattatcatcggagcggggaatctgggacaggccttggcaaactatactgctttcgagcgcagcgggtttatgctgaaaggactgtttgatgtcaatccgacgctggccggtgtgacggtaagagggattgagatccgcatgatggacgagctgaagagctttatccgaaataatgatattgagatcgcaatcctgactataccgaagacaaaggcggttgctgtggcaaatatgttggtggaaaacggtatccgggcaatttggaatttcgcccatacggatctgaatctcccggagcatattgtcgtggaaaacgtacatctttccgagagtctgatgagactctcctacaatgtactccgctatgaggagaagcatcagaagaaaaaataagagcaagaaggacgtgagagagttgtagtaagctgcgggattccacgtccttttttctgtccggataccagaacttaaaggaaggagcgataaggatgaactatattatagacggcaggacaatgaaagcggcagaccattacacgattgagaccatcgggatcccgtcccttgtactgatggagcgggcggccttgcaggtggtagaaacggtcaaaaaggaaaagattgatatcaccagaagcctgattgtgtgtggcagtggaaataacggcggagatgggattgcggtaggacgtctcctgttggagaaaggggcaaaggtgacggtggtgctcgcaggcaatccggatcattgcacagaggaggcaaaggaacagatccgcatctttcaggcaatcggaggaactgtggaacgggaaattccacaggaaagctacacggcagtatttgacgccctgtttggaatcggtctttcccgaaaggtggaaggacggtatgccgggatcctggagcggatgaatgagatggaagcagccaaagtggcggtggacattccgtccggtattgattcttcgacgggggaggtgcttgggacggcgttccaggcagatctgacggtgacatttgcttatctgaagacggggatggcactgttcccaggcgcgctttatgcaggaaacgtgcaagtcagggatatcggcatctatttgcggggcggcgtggaaggaccgcggtatctttcctatgaacgggaggatatcaaaacgctctgccccaagcggggcgcagatgcccacaaaggaacgtacggaagagtcttgatgattacaggaagcgaaggaatggcgggagcggcaattctctcagcaagcgcagcttatcggatgggaagcggattggtgaggatcctgacgccgaggtgtaaccaggcagtattacaggcgaagctgccagaagtcatcgtcacgccttacaaggaagagatttccagacagatggaaacgttgcttgactgggctgacgttatttgtgccggatgcggtctggggatggatgagcggaccaaagaagtcctggagacattgcttatctatctggaaaaccatgagaagccatgcgtccttgatgcggacgccttgaacaatattgcgggaatggaacaaaaaaagagggaaatgttgctttccggtgcggggagccgcttgattttcactcctcatgtgaaagaattcgccagacttcttggaaaaacgacagaggaaacgaaaaaaagcaggatgggacttgcacaacagtatgccaaaacctataatataatattagcagcaaaagatgccagaaccgtagtagcaggaaaggggaagattccgtatttgaatctgtccggaaattccgccatggccaaagccggatccggggatgttctcgcaggaatgatcacgggatgccttgcgcttggtatggagcggtttgaggcggcggcatttggcgtgtttgtccatggactgtgcggggatgaagcaagagaccgctatggggctcacagcgtacttgcgacagatctgattgaaatgacaccgattgtgctgcgggaaatccattgaggaaaggttcttacaaaatgaaaacttacagcagagtgtgcgcgaaaattaatttgaatcatattacatacaatatagagcagatgaggcatcatatttcaccggacacgaacatgattctggtggtgaaggcagacggatacggacatggcgccacaagaattgctaaagagacggaaagattggactgtgtatggggttatgccaccgcaacgcttgatgaggcggtgcttttgagaaaagctggagtgcaaaagccgatattggtgcttggatgtacatttccggagcagtacgaggaggccatccgccacgagatccgtatgacgatctacacagaacagtcggcaaacgcagtttcaaagcttgcaggaaagctgaaaaaaccggcatggattcatgtgaagctcgataccgggatgtccagactgggatttcagacgggggaggaatctatcgatgaaattgaaaggatcttttatctgccgggaatccggatggaaggactctttacccattttgccaaagcggacgagatggataagacgtttaccaaccgacagatggaagagtatctttttatgacgaggaagctgaaagaacgggggattgagccacagtaccggcattgctctaacagcgcggctatcatcgaccaccctgaggccaatctggatctcgtgcgtgcgggcatcgcactctacgggctttatccttccgatgaggtgagaaagcgtgatctcgcattaaagccggtactttctttagtgagcagtatcgttcatacaaagtggatcgagccaggggcggttgtcagttacggaggatgtttccgtgccgagaagaaaacacgtgtggctaccattccggtcggctatgcggacggctatccgagaagcctctccaataaggggtatgtgctgatccgcgggaaacgggccccgattatcggcagagtctgcatggatcaaatgatggtggatgtgacggagatcgacgaggcagcatttatggatgaagtggtgctggtaggaaaaagcggccgggaagaaatcaccgtggatgacttaagcgccctgtccggaagatttaattatgaatttctctgtgacctcgacaagaggattccgagagaatatgtaaaagatggagaagtcatcgagcaggtcgactatttcgcataaaagacccacggcttttggaatacttcaaaggaaagatggaaatactcattatatcttagaaaatggagtgtgaagaaagtgcagcaggttcatagaggagacattttttatgcggatttaagcccggtcgtcggttccgaacaggggggcgttcgtccggtgcttgtgatacaaaatgaaatggggaacagacacagcccgaccgtgatatgtgcggctattacttcgagaatgcacaaatcgaaactcccgacgcatgtggagattgacgcgagaaggtatggtgtcgtaaaaaattcggttgtccttctggagcagatccggacaatcgacaagcaaagattgaaagaaagtgtatgtcatctggatcaggaaatcatgcagaaggttgacgaggccctgagaatcagtatcgcactttctacataaaaggagaagatatggaccaaagggacacaatcagaaaagaggttctgggagccctcaaggagggcgaacaagacggaagtatcagagagatggaatacagaatgatccgcaacgtgttttctttcatggatcaggacgcaaaagatgttatgacccaccggaaaaatattgtggcattaaactgtgacgatacgctggaggaagcggcagcttttgcatctaaagcaaagaactccaggttcccggtctacgaggaggaaatcgataatatcctggggattgtacatatccgggatattatgaagttttatctggatccggacatgcgggggaaaaagttaaaggagatcggggacgcacttatgcctgtgggctttattccggagacgagaaagatcagccgactttttatgcagatgaaagccaaccagagccatctttgtgtggtgatcgatgagtacggacagacttccggactggtggcgatggaagatattattgaggagatcatgggaaatatccgggatgagtatgacgaggaggaagagatgatccgcaagagcgaggagggctcttacctggttgacggcctttgcggcctgacggagctttcagacgtccttggcatcgtctttcaagatgaggatgaggacaatgagtatgagacactcaatggtttcctaattgtgaagcttgagcggattccagcggagaaggaagagtgcagtgttttctatgaggggtatctttttgaaatccagcaggtaataaacaatatcatccggaaggtgaagatcaccaaaacggaacttgccacagaaacgaaagaatgataaaatgaagaacatgagttttcctgaaaaaggaagagagattacatacgaagagaggtagaaagaaatgtcaggacattccaagttcgcgaatattaaacataaaaaggaaaaaaacgatgcggcaaagggaaagatttttacaaagatcggccgtgaaattgcggtagctgtcaaggaaggcggcggagcggacccggcgaacaacagccgactccgtgacgtgatcgcaaaggcaaaagtaaacaatatgccgaacgacaacattgagcggagtatcaaaaaggcggctggagacatggacgccaacaattacgagagagttgtatatgaaggatatgggccgaacggtaccgcgattatcgtggaggctctgacggacaataagaaccgtactgcttccaatgtaaggagtgcctttacaaagggaaacggcaatatcgggacaccgggatgcgtatcctttatgtttgataagaaaggacagatcctcattgaccgggaagagtttgaaatggatgcggacgaactgatgatgctggctcttgacgcaggtgcagaggattttgcggaagaggaggacagctttgagatcattactgatccggatagcttctctgaagtccgcgaaaagcttgaggaggcaggaattccgatgatggaggcttcggtcactatgattccgcagacgtatgtagagctgacagatgagacagatatcaaaaatatccagaagacactggaccttcttgacgacgacgatgatgtgcaggaagtatatcataactgggaagagtagagaaggccggaattcgcagtaagggaggccgtcttatgcagacaggaccagaaaaacagatgatatccatgtttgaagaagcgatagagctttcctcacagtttaaaaaggctacatatgagccaactttccgtggcttttttgagagaagacgcccggagcttgccaggatgttaaaagagatccgggagaaggacgaaggaaggagaaagcagctcattcaggttcttggaacagaggttccggagtatgcaagcgagcagcttcataagctttcggacaagaggaagagagaaaatcggatcttggattacaatctggcattggtgacattttttattccattgctgctctacagccgggatcccgagctggaggcggtggcggacgagatgatttcctcctggaaccggattgatacggtgacgatgaaagtgggtaaatctacctttgaggagatcaacgggggattccgtaagcgtctttgctatgtgacgaccgcggtttgccggtccttacagaagccggatgagtgctacgagctcaaattgctcagagagtaccgggacaggtatcttgtttcctccgaggggggaaaggagaccattcgggaatactataatattgcgccgacgattgtaaaacggatcgaacgaatggcagaagccgacgttatctaccaaaagatctgggaagagtatctgaatccatgcatccatctgatcgaggcaggagagcttgcggcgtgtagaaccgtatatacaaatatgattcaggatctggagcaggactatctgttctcctgatccgcagagaaaaacaggaggaacaaggatatgaatgaacagtttaacattgaaaccaaatgcatccagtcaggctggaaaccaaaaaaaggagagccgaggattcttccgatctaccagagtacgacgtttaagtatgacacaagcgaacagatgggacgattgtttgacctggaggacagtggatatttctatacgagactccagaatccgaccaatgatgcggtagcagagaagatttgcgacctggagggaggctatgcggccatgctgacatcttccggacaggctgccaatttctatgcggtgatgaatattgccgaggaaggagatcatatcgtatgttcttccgctctttacggcggcacctataatctgtatgcccacacgatccgtaaaatgggtgtagaggctacattcgtggatccggattgcacagaagaggagttaaatgcggcatttcgtgacaatacgaaagctgttgtcggggagacaattgccaatccggcgcttaccgtgcttgatattgagaaatttgcgagggtagcgcacgaacatggtgtgccgttgattgtagataatacctttgccacaccaatcaactgccgcccgtttgagtggggcgctgatattgtgactcattctacgacgaaatatatggatggacatgccatgacagtcggcggagcgatcgtggacagtggaaactttgactgggaagcccacgccgaaaaattcccggggcttaccaaaccagacgagacttaccacggtattgtatatacccgtaaatttggaaaaggtgcttacattaccaaggcgactgcacagctcatgcgggatctgggctccatccaggcgccgcagaatgcattccttttgaatgtaggccttgagacgttgcatcttcgtgtgccgcagcactgtgagaatgcaaagaaggtggcttcctatttgaaaggacataaaaaggttgcctgggtgaattgtgctatgttggaaggggataaataccatgatctggcagcgaagtacatgccaaacggcacctgcggtgtcatcactttcggattaaagggtggaagagatgtcgctgtcaaaatgatggacagtctgaagctggcagcaatcgtgacccacgtatcagatgctagaacctgtgtccttcatccagcgagccatacgcaccgtcagatgaacgatcaggagctcctggaagcaggagtgcagccggatctgatccgttttagcgttggaattgagaatgcagacgatatcatctcggatctggaacaggcacttgccctcgtataatgcatatttagaaaaatacctccgcatactaagcaaaaaatgtggaggtgttttttatgggaaatcaggaaaaacaagagaaagaaacagagcagatcaaggagacggggagtctggagctagagacaaagcacggggactataaggtctatctgttgactattatcggggagatcgaagggcacgaagcagtctctggcagtacgaaagcaaccaaatacgagcatctgctcccgaaacttgccgagatcgaatccagtgatgagattgagggagtattgattctgctcaatactttaggtggagatgtggaggcaggacttgccattgccgagatgatcgcttcgttaagcaagccgaccgtatctcttgtccttggaggaagccattccattggagggccgcttgctgtttcttcggactattcgtttattgtgccgagcggaactatgattgtacacccggtacgttccaacgggatgtttatcggggtgatccaaagttaccggaatatggagcgtacacaggatcggattaccaagtttatttccggtcattcacgaattactaaagagcgtctggaagagctgatgctggattcgtctcagcttgtcaaagatgtagggacgcttttagagggtgaggatgcggtccgggaggggatcatcgacgaagtgggagggatccacgaggcctttgaaaagatttactccctgattgatgaacggcggaatcagaaggaaatcggggaacgagagcacaaaaatagataatgacagcatattttaaaaatgctataatgaaatatagtgaaaatgggaaaggcccgtctgaagcgggaaagtaataagggggatatttcatggcccagaagacgccacaaaagaagaaaaaaagtacaacagcaaagaaagcagggcgaaagactaccagatccacccggtccaaatccagccgttctacaagagcgacgaaagctcagatggagcgggagacgattgtcagagaggagattgtaatcctggtatctttggcggtctcgatcattcttttgattagtaattttggacttgcgggagcagcaggaagagtgatttcggactttatggagggacttttcggacagatgacgtatttgttcccatttctgctttttgcaggcgtcacatttttcctatccaatcgggggaatcataaagcatacacgaagcttggcgccgcagtagttcttgtagccttgatttgtgcctttttggagcttgtcaaccgggcgggaggcagtattggcgagaagatggcgcatttaacggtcccggcgctgggcgtagtcggctcgtatgtgattattgtgattttgatgatgatctgtttgattctgattacacagcgttcgcttttaaaaagtgtgcagaacgccggacgaacgcttcaaagtaaggcaaagactggcagggagcaccgaaaagtacagcgtgaggagaagaaaaaggtcaaagaagccaagcggcaggagcataaggtggcgggagtttcttttgatacgactttggagggacgcagtccggagatccaggagcttgttgtgacggaagaaaaaagcctgaaaaagaaagcagaaaagagggcaaaggagacggaacaacaggcggcaccaaagacccaggaagaagctccggccggagagcttacgattacaagagcatcctcctatgaagaaccgggggaaccggttctgacggaggcgtttgaggctgttccggatctctcagagtttccggaagagggaatcagtgcttttaaagaggctgtgaatccaaaggaagaggcaaagatcaggaccagagtaaaagctgagaataaggagcaggaggcagcggcaagagagcatgtaaccgctgagattgagaaatccatcgcaaggccagtctctgtatatcatgcgcctccgatcagcctgctgacccatggaaagaaggggacaggcgattccgacgcgcatttgagagagacggcagctaagctacagcagacattaaagacattcggtgtcaatgtgaccgtgacgaatgtgagttgcggccctgcggtgacccggtatgaagttcagccggagatgggagtaaaggtcagcaagatcgtaggtcttgccgatgatttaaagctcaatcttgcagcggcggatatccggattgaggcaccgattccggggaaagcagcggtcggtattgaggtgccgaataagggcaattccaccgtacagcttcgggatcttctggagagtgaggagttcaaagccgcaaaatccaagatcagctttgctgtcggaaaagatatcagcggacggacggtagtgtcagatattgccaagatgccgcatcttctcgttgcgggcgcgacgggatcagggaagtccgtctgtatcaatactttgattatgagtatcttatataaggcttccccgcaggaagtgaagctgattatgattgacccaaaggtggtggagttaagcgtttataatgggattccgcatctattaattccggttgtgacggatccgaagaaggcggcgggcgccttgaactgggcggtggccgaaatgatgaagcgttaccagctctttgagcagtacaaggtgcgtgatatggatggtttcaatgcaaaggtggaaagtgtcaaagatattgacaacgaggaggagcggccggagaagatgccgcagattgtcatcatcgtagacgagcttgcggacttgatgatggtggctccaggggatgtggaagaatccatttgtcgtctggcacagcttgcccgtgctgcagggattcatttggtgcttgcgactcaacggccgtcggtcaatgtcattaccggcctgattaaagccaacatgccgtccaggattgctttctctgtatcttctggagtagattcacggaccattatcgatatgaatggagcagaaaagctcctgggaaagggtgatatgctcttctatccggcaggcttccagaagccggcacgtgtccagggagcctttgtatctgataaggaagtgcaggcagtggtggattatctgctgacaaataatggaaatgctgcctacgatgaggaggttcagacgcatatggcaaatgcctcaagcggagcggccggatccggggcaggtggccagggagaagaacgggatgtctacttccaggatgcgggatattttatcatcgaaaaggaaaaagcatccatcgggatgttacagcgggtgttcaaaatcggattcaaccgtgcggcaagaattatggatcagctatatgaagcaggcgtcgtcggagaggaagagggcaccaaaccaagaaaggttctgatgtcaaaggaacagtttgaccagtacatagaggaacatgtttaggggaagaaacggaggaaggaaaatgaaaacagacattcagattgcacaggaagcgacaatggagccgatcaaacatgtggcggcatcgatcggaatcggggaagacgacctggaattctacggaaagtacaaggcaaagctctctgctgagctctgggacaagattaaggaccgcccaaacggaaaactcgtccttgtgacagcgattaacccgacacccgccggagaggggaagacaactgtgacggtaggacttggacaggcaatggcaaagatcggacagaaagcaatgattgccctgcgtgagccgtctcttggtccttgctttggaatcaaaggaggcgccgcgggaggcggatacgcccaggttgtaccgatggaagatctgaatctgcattttacaggagattttcatgcgatcacatcggcaaacaatcttcttgcagcccttctggacaatcacatccaacaggggaatcagcttggtattgatccaagacaggtcgtctggaaacgttgtgaagatatgaacgaccgtgtcctcagaaatattgtggtaggacttgggaacaagatggatggcatggtacgggaagatcatttcgtgatcaccgtagcttccgagattatggcgatcctctgtctggcggacaatctttccgatctgaagagacgccttgggaagatcattgttgcctattcttttgacggtaagccggtgacagcagatgatctccaggctaccggcgctatggcggctctgttaaaggatgccatcaagccgaatatgattcagacactggagcacacaccggctttggtacacggcggaccatttgccaatattgctcatggatgtaacagtgtgcaggctaccaagatggcgctcaagatgagtgatatcacgatcactgaggcgggattcggcgctgatctcggtgcggagaagtttatggatatcaagtgccggatgagcggattaaagccggacgctgttgttttggttgccacgatccgggcattgaaatacaatggcggagtgccgaaaaatgagttgaatgaagaaaatctggaggctttgaaaaagggaatcgtcaatctggaaaaacacattgaaaatcttcagaaattcggcgtaccggttgttgttaccctgaatgcgttttctgcggatactgaggcggaaaagggatttgtcaaagaattctgcgaggaaagaggatgtgaatttgccattgcggatgtttgggcacgaggcggcgaagggggcgaagagctggcaagaaaagtattaaatacactggagacgaaagaaagccaattccatccgctctatccggacgatctgcctttgaaagacaagatcgagacggttgccagagagatttacggtgcggacggcgtggattatgataaagccgcattaaagcagcttgcaaaaatcgaagagcttggatttaaaaatgtgccggtctgcatggcaaaaacccagtactccctctccgatgatcagacacttcttggacgtccggaaggatttcgcatccatgtaagagaagtttatgtcagtgcgggggctggatttgtcgttgtgctgacaggcgcagtgatgacgatgccgggacttccaaaagttcctgcggcaaatcatattgacgtaacagatgacggaaagattacaggactgttctaaaaggaggcagactatggcagtattgatagacggaaaagtaatttccacaaagatcaaagaggaattaaagcaggaagtgacagagatgaaggcgcaggggattacaccgtgtctggctgtcatacttgtcggagacgacagcgcatctgccatttatgtaaggaacaaaaaacgggcatgtgagtatgtcgggatcgaatcccgttcttacgaactgccggaggatacgacgcaggaggagctggaaaagcttgttacgagccttaatgaagacgagaacgtagacgggattttagtacagcttcctctgccggggcagatcgatgaagagaagattacaacgatgatttctccgaagaaggatgtggacggatttcttgcagatagtattggagcgctttgtcttggaacggagggattccgttcttgtactccggcaggcgtgattgagctaatacggcgttccggttattctatcgaaggcaaggagtgcgtcgtagtcggaagaagcaatcatgtaggaaagccgatggcgcttcttttgctccaggaaaatgggacggtcacgatcgcccactcacggacaaagaatttaggagagatcacaagaagggccgatattcttgtggcggcggtcgggaaggcaaagataattaaggcttgcgacgttaaggaaggagccattgttattgatgtagggatgaaccgggatgaaaacggaaaactctgcggagatgtggactttgaacaggtgaaagaaaaggcagaggctatcacaccggtcccagggggagtagggccgatgacgattgcgatgctgatgaataactgtgtggaggcggcacggaaaaagaggagagaataagggtaccatgcaaagaatgacaaatccaggggacagactgtcagaggaagagatcagaaggagaagaagacgggccaaagcagaacggatgcgacgcaaaagaagactgcgtaggcttgtgattctgggaatgatcctgattgttgcggcggtagtcggagcgggaattctgatttatcgaaatacatataccggtgtagtaaaccggggaaaaagagccgagataaacgggaatgatacaaaagcggaagcgctttatttaaaagcgattgagaaaaagggggaaaagaaagaggcctatttcagactggcttctctctatcacgaccagaacaaggatgacgacgcggatgcattgttacaggaagcagtggatagccatccggatagtgtcggcgtttatcaagctatggtagaatactatgaggatacggaccagacagaaaaaatcgcctatctgatgagtacctgtaccaacggtcagattttgacagaacttcaggattatgttgccagagttccggaattcagtctggatgatgagaaagaatacgataatgtgcaggaactcactctctcaagcgaggaggacggcacgatctactatactgtggacggaagtaaagcgactaccgaaggcacggaatataaggagccgatccaaatcaataaggaaggaaaaacaaccgtcagagcgatctttgtcaataaaaaggggattgaaagtgtagaggtgcaaaaaacctatatgattcgattccctgtggcagaagcgccggcagtctcgccgacaacaggtcagtataaggaaccaatcagtgttgaggtacaggtcccggaaggatatacggcttattatacgacggatggaagcgaaccgtcagatcagtcggtcaaatataccggtgctttcccgctttatcaggacacggaactcaatgtagtattgattgacggcaatggaaagaagagtgagattacgacaaggaaatatcagattcgttcttgatacaggaacatgaagaggaaaatcgcagaatatatttccgcgattcagactgtagtcttcccttcagtcggtttaggaaaactctaaaaggggacgaaacaatggatgaatacgaaagaaatatcatacctcagattgaagcaatttacgatacctttactgcactggaaaaaacaatcgcggattattcactattgtggacatgttatcaaagaaaaagagaatctatgtttacggaaagggaagttccggtctggcagctatggaaatgaagttccgttttatgcggatcggcgcaaatattgaggctattacagatgaacatattatgaaaatgaattccgtccttctggatggagactgtgcggtaatcgggatcagtgtcagcgggaagaccgaagcggttctggaatccatgaagattgcgaaaaaatgcggagcgaaagtaattcttatgacggcacacaccgggaagaaatttctggaattctgcgatgagatcatgctgtttgcgctgaaagaaaacctagaacaggggaaagccatttctccacagttcccgattctcattatggtggacatgttgtattctcagatgcttcaactggatgaataccgaagggaaacactgcatgaatatacgcttgaagctttggatgaaagataatctgcttgttaaatcctaagatgtttttgccatagatatagcttattaaatcagtgattcaataaaaaattctaaaaaccggaaaaatgcattgaaataactaaaaaacaggagtatactaacgatagttaaaaaaatatcaatggtagaaaaggagagacgagctatgagtagattttgtttaccaagagacatttaccatgggaaaggatgcctcgaagaattgaaaaacctgaaaggaaagaaagcaatccttgttgtcggaggcggctccatgaagcgtcagggattcctggacagggcggtttcttatttgaaagaagcaggtatggaagttcaactctttgagggggtagagccggatccgtccgtcgagacagttatgaagggtgctgaggctatgagagagtttgagccagactggatcgtttccatgggcggaggatccccgatcgatgccgcaaaggcaatgtgggcattctatgagtacccggatacgacatttgaggatctctgtacaccgtttaatttcccggaattaagacagaaagcaaaatttgcggcgattccgtccacatccggaacagcgacggaagtaacagcattctccgttatcacaaattatcagacaggtgtgaaatatccgcttgctgacttcaatatcacaccggatatcgccattgttgacccggatcttgtagcaggtctcccggtgaaacaggttgcttacacaggaatggatgctctgacccatgcgattgaggcttatgtttccacattaaacggaccatttacagatccgcttgcacttcaggcaatcgagatggtacttgattatctgccggcatcttaccgttgtgatatggatgcgagagagcagatgcattatgcgcagtgtctggcaggaatggcattttccaatgcgttgcttggtatcgttcactctatggctcataagactggagccgcattctctacaggacacattccacacggatgcgcaaatgcaatctaccttccgtacgttattcagtataatgcaaaagatcctgtagcggcaaagcgttatgcggagatcgcacgcagaatgggacttccgggaacttctgagaaagcgcttatcaatagcttgattgcaaagatcgatgcatttaatgtagagcttggaattcctaagacattaagagagttcggaatcaacgaagaggaatttaaagaaaaaatttccaatattgcaaaacttgctgtcggcgatgcctgtacagggtctaatccgagaagcattactccggccgagatggaaaaactctttacatgtacatattacggaacagaagttgacttctaaaccggttatgaccgtcgctttttcggaagcggcggttttttataccaggttgtgaatcttttatcgaaaaaaacgatttccctgtcagaatctacttgatattttatctacaatatcttatgataaatggagtataacaattaggaggcatgagagatgtacaaaattttaaaagctgaagaacttgcagataagatttttctcatggatgtagaagctccgcgtgttgctcgtcactgcgagccggggcagtttgtcattgtaaaaatggatgaaaagggcgagagaatccctctgaccatctgcgactatgacagagagaaagggacaatcaccattgtattccagattgtcggagcatccacgttaaaaatggcagagttaaaagcaggagattctttccgcgactttactggaccgcttggatgtccgtccgaatttgtaaatgaagacctggaagctttaaaaaataaaaagatgctttttgttgccggaggcgttggcgccgcaccggtatatccacaggtgaaatggttacatgaacgaggaatcgacgcggatgtaatcgtaggttccaaaacgaaaaatatgttgattcttgaagaagaaatgaaagcggttgccggaaatctgtatgtatgtacggatgacggaagctacggacatgcaggcatggttacttctatggtggaaaagcttgtaaaagaggaaggcaagaaatatgatgtctgtgttgcgatcggaccaatgattatgatgaaatttacctgtctgatgacaaaagatcttggaatcccgacgattgtcagcatgaatccgatcatggtagacggaaccggaatgtgtggagcttgtcgtctgcatgtaggagacgaagtcaagttcgcatgtgtggacggaccggaatttgacggtcatcttgtagattttgacgaagcaatgaagagacagcttatgtataagacagaagaaggaagagcgatgttaagactgcaggagggcaatacacatcacggcggatgtggaaattgtggaggtgacaactaagatggcagacgtattaaagaaagtaccggttcgggaacaggatccgaaagaaagagcgacaaactttgaagaagtatgtcttggatataatgcagaagaagcaatggaagaagcgacacgctgcattaattgtaagaatgcaaagtgtattcagggatgtccggtagcgatcaatattccggcattcatcaaagaggtaaaagaaggaaatttcgagggcgcatataagaccatcggtctgtcttccgcgcttccggcaatctgtggacgtgtctgtccgcaggagacacagtgtgagggaaaatgtatccgtggtatcaaaggagagccggtttctattggtaaactggagagatttgttgcggattacgctttggagcatgatattaagccggtaggagcagaagagaagaatgggcacaaggttgctgtcatcggctctggtcctgcgggtctgacctgtgcaggtgatcttgcaaagatggggtatgacgtgacagtattcgaagcgctccatgaacttggcggtgtacttgtttacggtattccggagtttcgtcttccaaagcagaaagtcgttgcaaaagagatcgaaaaggtgaaagaactcggcgtgaagttcgagactaacgtggtaatcggtaaatctacaacgatcgatatgctcattgaagaagaagggtttgaggcagtattcatcggctctggcgccggacttccgaaattcatgggtattccgggtgagacagcaaacggtgtcttttctgctaatgagtatctgacaagaagcaatctgatgaaagcttttgacgacagctacgacactccgattgttgcaggaaaaaaagtagccgtagtcggtggtggaaacgttgctatggacgctgccagaacagcactccgtcttggcgctgaggtacatattgtttacagaagaagtgaagaagagcttccggcgcgtgtggaagaggtacaccacgcaaaagaagagggagtcatctttgatcttctgacaaacccgacagaaattgtgacagaagacggctgggtaaaaggcatgaaatgcgtgaagatggagcttggcgagccggatgcatccggaagaagacgcccggttgtcatcgaaggttccgaatttgagatggaagtggacactgtgattatgtcccttggaacttcaccgaacccgctgatttcttctacaacagaaggtttggaagtcaataagtggaaatgtattgttgcggatgaagagtttggtaagacatccaaaggaggcgtgtatgccggaggagatgctgtaacaggagcggcgacggtaattcttgctatgggagcaggaaaagccggagcaaaaggcatccacgaatatctgaaaaataaataatcccacgggaattttacaaaagagaagcatggagctgtagattcaaatctgcagcttcattttttcttggaatgaaagagaaaataaggtataataaatagaatacatatcatcataccaggggtgaccaaaagtgagagaagaaatgaagataatgattgtcggtatcgggggcgttggaggatacatcgcagggatggtcggacaaaaatataagaatctgacattgatagcgaggggaaaacgaggtgaggcgctgcgtgagcatggtgtagtgctgcacagtgattttcatggagagaaaatcgtaaaagatggtgtgatacgggagtgtgcgagggaagtggaggagattcaggacctgatttttctttgtgttaagacttatgccctggaggacgtgtgccagacattgggatcttgtgtagatgaccatacgattattgttccggtaatgaatggggcggatacagcccagagagtgagggagtatctggggaaaggacttgtggtggatgcagtgatctacacgactgccgccgcaaacgaggattactctatcacacagctcggacagtacaccagaattcttctgggagctgtgcgggaagaggaacataaagcggcgaaagtgtcagccggtgttctgggagaagcagggattgaatacgagataccatcggatgtgagacaggccgtgtgggagaaatacatttttaactgcgcctataatgtcattacggcatattatttgggaaatgtggaggagatacgggcatacgaggacaggagagcggaatttcatatgctgctgaaagaagcacttcaggtggccaaggctgacggggtacacatccggcagcattatatggaagaggaataccagagatttatgagactgagtaagggatccacaagttctttgaagcgggacgtggaggcgggaagaccgtcggagctggagacgtttggaggttatcttctggaaagggcaaggaatcttggcgttgcagtgccactttccgagcaattttatgatggtatgaaagaaaagatcagaaacaggacagactagaacaggcagaaggaagaacgaggtaagaagggtgacagcaaagaaggaaacatcattggaaggtatgaaatttttagaagagatcgtgcgaaagctgaaaaggaaaatcgtccagatggatcaggagattcttgccggacagaaagatatcgagagtatgcatgagtactactgggagaattatacggagatggaccagtatgggtacgaggactacgataaccagcaggcactgctccagcgtatcaatgccaatcaggatactttgcgcctccggtcacgttataagaagatgctcgattcgccgtttttcggaagagtagattttcgctacgatggagatgatgaaccggaaattttctacatcggaatcgggaattttgccgaggaggctggcaggattccgctgatttatgattggagagcgccggtaagtgctctgttctatgactttgacaaaggagaggcgtcttacgaggctccggcaggtcggatgtgcggggaaatcgaagcgaaatggcagtacaagatccgtagagggaagatggtctatggatttgagagcgatgtaaagattgatgatgagattctgaaacaggaatttggaagcaacagcgacatacagcttaaaaacattgtccggacgattcagaaagagcaaaatgcaattatccgtaatacaaaggataaaattcttgtaattcagggagcagcgggaagtgggaagacatcggtggcacttcacagaattgcctatctgctttatcacgatagaaagaatttgaaatcgtccggtgtgcttgttctatctccgaacagtgtgttttcggattatatttcccatatccttccggaacttggggaagagaacatccgggagatgagcctggatcttttcgcataccgggaactgaaatctgccgtaccggactgcgaggaccgctatcatcagatagaaaaaaacattgccggaataaaggaagacgacttgagccgctatcgctttaaacagtcaaaagaactgattggtgcggtcgaaggatttatggcgcagatggaggagtggctcgtcaatctgaaaggaatttatttccggggaatggaaaagactgaagaagagatgattcgtctgttttactttaaatttcaggatgttccggttttggctcggatggatgcagtcatagagtatgtggtggatgagtacgagacgagatacagcatgacactttctgaggaagacgtggagaaactgcggaccaggtttcaggcaatgtacacgactacagatctatatcggatttataattggtttttggaggaacagcatttcccgaaacttccagaggtaccgtatgacagacgttatctggagtacgaagatgtttttccgatgctgtatctgaaatatcggttacttggtgtaggaagacaggatcagatacaacatctggttgtggatgagatgcaggattattcctacctgcaatatacgattctggggcttttatttcagtgtccgatgacaattctcggagaccgttcccagacaatggaggaaaagcaaaacgatgtgacacggttccttcctcagatactggggaaacagcttcggaagattgagatgaacaaaagttaccggaatacagtggagattgccgaatatgcaaggacactggttgggatggatgatgcagagcttctgaaccgccacgggaaagcggttgcagagcgggagtatggatctaaagaagagatgatcagtcatatcctggagcatgtcaagataggaccggaagggtatgagacagcggcagtgcttacgatgacagaagctgaagccagagaatggtacgagatgattcggaagaaaacagatcaggtacactatattgatcgtgacagctccagatttgggcgtggactgaccgtgacgaccttttatatggcaaaaggtctggagtttgaccaggtgtttactgtggcgcataaagaagagacgaaaatgacaaggcaggcagaatatatctgtgcgacaagagcgcttcacgaactggaggtttgccgaatctgagcctgacaggagggaaagggatgagaaagatcaatcaaaaagagcattatttctatatcgatattctcagaatactcgcctgtctttgtgtgatatacatgcagtgcaacaggattgcagatccgtatacagatacttcggtatatcgccagaggatgtttgttgaaacgattgcttactgggcggttccggtattttttatgatatcaggagcgactctgtttgactatagagagaggtatcagaccggtgcttattttaagaagcgttttcttaaaacaggtttaccgtttattacgtggacactgatcaatctggtaataaaggtagctttgggacagatggagtttcgaccaagtttgtctggtatgatcgatttgtttaccaatacaactgcggaacaggtatactggtttttcattccgctatttatgatgtatctctgtatacctgttctgtctttgttaaaagattacaagcagattttggcttatatgacagcgatggcctttttagcttattctgtttatccagtgtgttgtacttttttgggaatttcattcaatggaaatatccagttcccggtggcgggaggatatttactgtatgtgattttagggtatctgctttctacaacagatatgtcaaagaaaacccggatgtttctttgtatacttggtgctacaggagccggaatccggtatatcagtactgtggcctggtcaacgaatagttcaggactgaatcatgctttctggggatatctatcgttcccgacggtatttctggctgtcggagtgttcgtggcagttaaatatgggccatggaaaaaattggaacaaaatccgggaattcggagggcagttacaacacttgccagtacagggctgggcgtatatgtgacacatatgctggtattgcagactttgcaaaatctgacaaagcttggaacggaatctggatggtggcgctttgtaatgccgtttgtgatttatgtgatctctgttatgtcagtactgattctgaaaaagattccggtgtttcgggccattgttccgtaatgattacatagacagaagaaaaggagaacagcgtgaaaattacattgattaccgtaggaaaaatcaaagaaaaatatttaaaagatgccatcgcagagtatagtaagcgcctttccagatattgcaagctggagatcgccgaggtggctgatgagaagacgccggatcaggcaggcgaaaccgtggaggaaaacattcggaataaggagggagagcggattctgaaatgcatccacgatgatatgtatgttattactctggaaattaacggagtgatgcttggatcagaagagtttgcaaggaaggtcgaacagctcggtgtacagggaaacagcagtatcggctttgtcatcggaggatccattggtcttggaaaagaggtacggaaacgcgcagattatgcactgagcttctctaaaatgacgtttccacaccagttgatgagggtgatccttttggaacagatatatcgggcatatcggattatcaatggagaaccatatcacaaataagtgcgttttgtaaaagagtggacatctgatgttccgctctctctttttgtataagagagaaatagaatgacagaggaatattcagggtgatataatagtttaaagcagcttgacaacttgctttttgtgaaggagataattatatgagaaaattaggttcagatgttgaaaaaattatgattgaacgttttggaaaagacacggtgatcgcattagcaacagcggaacaggaagtgccgtatgtgcggaatgtaaatgcatattatgaggatggttcattttatattattacatacgcacttactaacaaaataaaacaaatagaagagaacccaaatgttgcgatagcaggtgactggtttaccgcacacggtaaggggaaaaatttagggtattttggaaaagaagaaaatcgtataattgctgagaaactaaaagttgtttttgccgaatggattgataatgggcataataattttgatgatgaaaacaccataattttatgtgtggaattaacggacggactgttactttcacatggaacaagatacgagttttaagcttcaaattccatttatcatggagttgaacagagtaatattacctaatttgtgaaggagtaaaaagtgtatgattttatatcatggaagcaatgttatagtccaggaaccgaagattttggaaaacggtttttacaaagattttggatacggattttattgtacaattttagaaaagcaggcaaaacgctgggctttgacaaaacgcggaacgcatattgtaaatttttatgagtatttacccgataagagcttggatattaaaacgtttagtaagatgacagaagaatggctgcagtttgttgtaaactgccggcttggtttaaaacatgattatgatgttgtagagggtccgatggcagatgatacaatctgggattatgttgaggactatatagctgaacgaatttcgaaagaggcgttctgggaactggttaagtttaagtatccgacacatcagattgtattctgtacagagaaagcattacagactatcaaattcgaagggagttattcgctatgacaaataaattttttccggaagaacaaatttccgagaatgatctttattttttgtgctatatggtagaacgtgttgcgcgaaaattacatcagaagaataaatatgttgttaattctataccgaaagaagagtgggagcgcctgttcagtcttgctaatgtgttgcattgcgacaatcctttgaaaattgaagctgaatggatcgaagagtataagctgacaacagggaattttgatattacggatgtcgatttagaactagtagacaagatcccatcagaaacacagatggggaaagtatatacaaggctgattctgtcaacgttacagccagaggaagattatatcgatggaatgattcgggtatacaatgatgaaatatgtaatacaattgataattacaatagcagtgcatattatgaaccatcttatgtgataacaagagcctataataatggaggattttaagaggagaacaatttagtataacggaggagtgatttatgattttatatttttcgggaacaggaaacagtgcgtatgttgcaaaacgaattggaaaagaagtaatggatgacgtaataaatttatttgaaaaaataagaaataaggacaattcaaaattatactcggaagattcatggatcattgttgtgcccacttatgcatggaggataccgcatattgtacaaaactggatagagaatacagaatttactgggagtaaagacatttattttgttatgacctgcggtgaaaatattggaaatgcagggaaatatcttaaaaagttatgtctccagaagaatatgaattactatggttgtgcagaaattgtaatgccggagaactatattgcgctgttttctactccaacagaagaacaggcaatggagattatagaacgggcagaagttgtcatagacaaggtggcaagttatatcagaaatggcgaggagtttccacaggcaaaaatttctattggggatagaatgagcagtggtattataaatgatctattctatcccttatttgttcatgccaaaaaattttatgtaaccaatacttgcatttcttgtggaaagtgtcttgatgtatgtcctactaataatattcggatggaaaacaagaaacctgtatgggcggaaaactgtacgcactgtatggcgtgtatcaatcgttgcccgaaagaagcgattgaatatggaaaacatagtcatgggttaccccgatatacttgtaaaaaagaaatgttatactagaaaatacttgtatgtgataaatcaaagtgtatggaggaaaattatgcttgataaaattcctaatgcagaggaaatgacggctttggttggacaatcattatatgatgtatggaataagctatgcgctttcattgacaaaaagtatgaaatggaacatctgtggaataaaggtggaaaggcatgggcttatgaatacaaatatcgtcaaggtggtaaaacactttgtgcattatacgctagagaaaattgtataggatttatgattatatttggaaaagacgagagagaaaaatttgaagcagaacgtaataattattctcaacaagttcaaaaaatttatgatgaagctaaaacttatcgagatggtaaatggataatgtttgaaccgactgatacattaatgtttcaagattttattaaattgctaggcattaaaagaaaaccaaataaaaagtaataattgtcatgctgccctatacaaaattaggcgttgaggaggtacatacgcatgaaagaaatgattgcatattgcggactggattgtgagaaatgcgacgcatatatcgcgacaattaatgacgaccaagagttgagagaaaaaactgcgaagctatgggctgaattaaataatgcgcctatttttcctgaacatattaactgtcaaggctgtcgtgttgagggaattaaaactgtattctgcgatagtatgtgtagaattcgccagtgtgcattgaaaaagggtgttgatacttgtggtgactgttcaggtttagaaaattgtcccactgttggggcaatcctagaggataatccgtctgctttgaaaaatttgaaagaataacttctcaatttaaacaattttagatacgttatgaggagctgtagtttagaaattctttatttgacatcttgaagatgagctggtatacttcctctccagtaaaaacagaggagtgatgctgtatatgactttttatcaggaactgcaattagaccaggccggatccaaaaaactgatccaaaatacagaaggtataaaaaataaacttcggcatacgacggtctatctgttcaaaatttttcttacgattgtattctgtgtcgcttttgtttccgcatacagcgggatcttcggaagtgagaacagcattgtaggtgtagtggtgcttctttgcctgatggtgttccgatttgcggatttcggagtcaagacgggttcgggactggcgatactgtttcttcaattttttattctggcagttggtcccagactggcaaatatagtcccgtctggagcaggaatgatcgtccatgtggtttccatttctttgatcttgctgtttggctgtcaccatgtgatgatggccaatcattccacattggtcttgagctatctgctgctgtacggctacgacgcggaaggaaaagcttatgtgcttcgtctggcaggactgctcttgggggcagtgcttactgaaatcgtatattacagaaagcacagaaagcagacctataaaagaacctttttcagcattgtaaaggaactgcgtcctacctctcttcgcacaagatggcagctttcgatggccttaggtattgcttctgctatctgtatcgtagagtgcctgggacttcccagaggtatgtgggcagggattgctgtcatgtcggtaatggttccttttgagaaagacgtgaaagaacgaataaaaggcaggattccgggaaacctggtcgggggactgttgttcagccttttatttctactacttccgaaaggctttctcccctacctgggaatgttgggagggatcggagtaggcttttccgctacttacggctggcagtctgtgtttaattctctgggcgccatgtctgtggcggcagggattctgggatttccaggagcagtattttttaggattttccacaatattttcggagcagtatatgggcacctgttttatagggcctggaatcggctgacggacagtctctgcacagaataagtaaattttctgcctgtaaaccaggaggatataatgaaacgagaattaggaattgctcgctgtgggcttgcctgttgcttttgttctgaaaatatgacatgtgatggctgtgattcaggtgcatgtccagacaaagactggtgtgaaaacaggcaatgctctatttctaaaaaaatagaacattgttatgagtgcaatgaaaaatgtagaaagggattacttagtaaaataaaaccatatgcttttactgaatttgccagaagatatggtaaagagtttcttttaaactgtcttgaaagaagcgaaaaaaatggtattatgtatcaccgggatgagataaatggtgattatgacgactttgatgatgtagagacgttgatagaatatataaaaaccggatacagacccatatcctaacataaaacgtaaacaggatagaggtataaaaaggaggaagacagaaatgcttacaatccgtaatgaggaacctagggattatgaaattgttgaaaggatgacacgaaattctttctataatttatatatacccggatgcatggaacactatcttgttcacataatgcgagagcataaagattttattcctgaactggactttgttttggaacttgataataaggtcgtgggatatatcatgtacacgagggcgacattgacagatgaaaaaggaaatatgaaacatatcttaacattcggaccgctttgtatagaagcggattatcagcgcaaaggctatggaaagctgctgatgcagcactcatttgaaaaagctgtatcgatgggatatgatacggtagttatttttgggatgccatgtaactatgtatccagtggatttgtaagttgtaaaaaacataatatctgtgtagaaggggagaagtttccggcagctatgctagtaaaagagctaaaagaaggtgtgctggatggccggaggtggtactatcaagatagtccggtgatggatgtttctcttgaagacgcgcttgcctatgacgataccctacctcagaaagaacgtaaatatacctatgcacaagatacattttatattatgagtcattcttttttagagtaatacaatgtatggctgataggttataaggagagggcagtaagttttgtaactaaccattttgcggattctgccgtctatacagagaaagtccaagaagaaatctctatataaaatgaaaaaattcccttgaaacattaaaaatgaatttgcaaataataatcaggaagccaatttcatttttgaagggagttgttggtagtgaagatacaaaaagaacatttggcgattgcgtcggttcctgtccagagctagggtgaactctataatcaggatgacgcactgaagaccggcaccattttcaaagaactggatttgccatttttcgctgcagaacagatccgtgcttctctgacttctagcgagatgcgttaaaaagccccgaagagcaaaaatgtaatgaaagactgttggaaatacaaaaagtcagctttgtgatggatgacctgcgactatacctggacacacatccggatgatctggatgccctggcaatgctaaagcgtgtgcatcctcgataccttttacagcaaagtaatttcagtcctaaggagatgcaattacggacttgacagaaaatctggttcagaggtttggtgaagcaaaccgggaagattgtagtaaaatccaaaacgcggaaggctcacagattcagcattttgggaaaggcactatcaatcagaacaattgcaggacataggtatgcgccgccggattttacagaccgttctattttatagaacgacgtggagaaaatagaaaaagccaagaactcacagcttgcaagagagattaaaattgcccgtagaacttgacagggaacagcagatacagcttgtacgggaatatgtgaaacaaaaactaatcgccgcactgttcaagtttcactttgtccgataagctaaaaactgaataccagccgccaccggcggccagcgaaagcaataagtctgaaaaagatttgatgcttttttattgtccatttggcaaaatcacaaaatcacccttagcaggtaggtgaagtcagataaagcagcctgaccttatcgctctatgttcggaaaaaccggtcaggggcaacctactgtaattacaaagcaagtttctgccacggtgccgaaatccgcaattctgcggttttgcccctcacgggaaacttgttggggagtaccttctccaaactctgctttgcggcttgctccctacggtatcagccggtcggaattcctccggcaggcgatacggcggtcgatcatacgtcctgttatccatgtatcggcggtcaatgacgaacggccaaccgtttcccagtttcagatttgacatcgtatgggtttggaattagaaaaaagcggctcttatatccgaggtgtgaccagtggggcggtcttgccatcgctcaaagaacttttcaatatcatagcgtatttcaacacgacaccggtggaatttttcgctccatgagaagatgatgattccatctatcataagttctgtaaatagttgcgaactttaagtgatgagaatttggataaagcttgaacgctactcgggttttatcgttcttgataaaaccactatgttggtgaaaaaaagctattcaaaaaccaagagtaagctacaagtgaaccatacctgttcagtgaaagaggttttattttatagatagtccttttataactgataagggtatagtataataacaaaaaagatgtaggaggagaacgatatgaatttggtgctaagtgacagaaatttagattcattctgtcagcagcatccaaccatacaatttattgatttatcgagattaaagatagcaaactgtgttggttgttttggctgctggacaaaaactcccggaaaatgcgtcatacgcgatgatgcagtaaaagtttatcccctaatcgcagccagcgatcgaatactgtatgtaagcaagcttaaatatggtggttatgatacgataatgaaaaccatgcttgaacgaagcattccggtacagcaggcgtttattcgtttattacacggagaaacacaccatgttcaacgcaatgtcgtacccaaagcggcagtcataatcggctatggagatatttctcccgaagaacaagatatttttcgcgcacttgtagaacggaatgcaaaaaatatgagttttgaaagttatcgcattatatttgttacaggaaatgaagtcgaggcagcagtaagcaaagaggtgacagcatgggaaaagtgatgattataaatgccagcccgcgggctcccaagtcaaattccaaacagtatgcgcagcttttttcggagtattgccgcttggatacggaatactgtgaagtcaagaagtccaatcacttgacactttgccagatgattgaaaattactcagacattgtatttgtgtttccgctttatgccgacagcattcctgtgacattccttaatttcttaaaagctttggaggaaaatgttcctctcaaaaagcccactatctctgttgttattaactgcggctttattgagccataccaaaatgacattgcggttaagatgttgcagttgtttgcaaaaaaaaatggttatccttttggttccgtactcaaaattgggagcggcgaggcaattttgacaacaccttttcgtatttttttgaaagcgagaatgaaaaaatttgccatctccatagaaaaacagaaatacaataattttcaagtgacgatgccgatttctaaaaaaatgtttatcaaagcatcaactgcctactggacaaattatggaaaaaagaatggcatatcaaaagaacaaatggaaattatggaaattgaataatagcttgtaaatttatttggagtattccttgaatgccagaacaataaatagttactgtttgaaaatcttatcacgcattatagaaaagtatgcaggaaatcagaaacgttttcctgcttttcttttgcccaaaatgaggcggtaaaccaccaccccatccaatcaaccacagcaaggaggacgccattatgccctgtctccgccacgatataaaaatcgtccagcgcagtaaccgccagtcagccgtcgccgccgcagcttaccagatcggcgaacggctgttttccgagtacgccagaagcagaaatactattctgcttgctcgcaggattgtgctggcataccgagggaaattccctcgaaacagcacgctgacctgatccgggacaattgccgggagttgttgtttccaaaggcatgatttggaaaggaaagaatagcaaggtgtatcggatcagtcttgatacaccttggtgttttttattcaggagagaatctttcaacgatagttaagtttggttttcgcacaaacagtgtaaaagcgcagtcatttttacaatagtgaaataactgttctgtaaagaagtggagaagtttgatatgaaacaggcgttggatttatggtttattaaccctagagatcaagagtttcaggagccatctttccatgagaaagatttaaataatttggaagtgctttccgataggaggcttttcagagaagaaataaatcagtattttgacgatgtgaaaaagaaaatttttatttatctgtcacagcttaaagaggaattacttctggagtttccacatggatgcgaatattgcagatttaccttgattctggcgcagtttcgacatttacacactcatatgggaatgattatgggatttatcattgatgatgagaatttatggtcaagcgtgctgggactggagatgccatttccagaagaaggatatagtaaatacatgtgatcccacctgatttttttattggtcagacagtcccggatctggggaaaggcagaaaaattagtataaagcgttcccggtgggaaatcttatatagaaaagaccacaggaggaacgtgatggaatcaatttggagccaaacatgtgagttgacaaaaagacctgccctgtcaaaggacatcgaagttgatgtcgctgttataggcggaggcatggcaggaattttgacagcatggcagttagaacgggctggagtgcgaactgtagtgttggaggcagataagataggagggggccagacaaagaacacaacagcaaagatcacatcccagcatgggatgttctgtcatacatttcttgcaaaaaagggagaagagaccgccagaaaatatgtacaggcgaaccagcaggcggtggaggaatacaaaagaatcatacaggaaacaaaaatagactgtaattttgaggaaacagacgcttttgtttattctaaagatgaggggaagctgatgcaggaagcagaagcggcaaagaggcttgggatcgatgtgtctttggagcgccatctggagattcctgtggattgtacaggagcggttcgtttcttcggtcaggctcagtttcatccgttgaaatttatatgcgagttggcaaatggacttcagatttatgaagatacggtagtgacagaagtagaggatcatctgatcagaacatctggcgggaatgtgctggcagcccagattgtgtttgcggtacattatccgtttttaaagttcccgggaatgtattttgcgagaatgcatcaggaacgctcctatgtgctggcactggaaggggcaggaaaaatccacggtatgtatattggagacggggaggaaaagttctcctttcggcaatatggggattggcttctgcttggcggcgagggacaccggaccggggagaaccgggaaggcggatgctacatgagactgaaagaaacggcggcaaagctgtatccggggagccatgtggcggcagcctggtctgcacaggactgtattacatcagacggcatcccgtttattggaatctatacatccgatagaccgaactggtatgtggcgaccggatttcagaaatgggggatgagttcctccatggtttcagctttgattttgaaagatttgatttgcaacagggaaaatccgtttgcagatgtgttttctccgtcacggttttcagcggaggagattccacatatcgtaaaagatggaaaaaaggcggttgcgggactgacgagacggttttttcagattccggatgagactatttcttctctggaaagagggcagggtgccgttgtcacaacatccgagggaaaagtgggcgtgtataaaacagaggaaggagaaatcaggcaggttgatattgtctgtcctcatatgggatgtcagttgtcctggaatccggatgaacaatcctgggactgtccttgccacggttcccgctttgatgttgaaggaaatcttctggatgatccagcgcaggaaggaatacaatgcagtggcatacaggagtaagagtcagaaggagtacagaaacgtactccttttttgttggcgacgagctagaccaggctttccagaaaccttggcgactgcccgcaatcctgggatgtgctttttgacacttccggtaattcgttgagtaggtggcagaaacacggaaaaagatagcaaaaatccgataccagtgctacaatataagtattgaagcgagcagaagtcggaaaaggaggaaaagctatgatatatctggactggtttacctttccggacgaagaggtggaatttgatttttttatgaggcagaagcgtacctgctatgattctttttatccgtttcagattctttccagacaccatttccgacgcatagattttgccccggtcaccattttgtacggaggcaatgggacgggaaagacgactgccatcaatgtgattgcggaaaaactcgggcttgatcgggacagtgcgtttaatagatccaatttcttctgggattatctggaacggtgtgactttgaagcgcgcgtcccgctcccaggtgagagccggattatcacaagcgacgatgtgtttgattatatgctgaatattcgcagtatgaatgagggaatcgaccggaagaaggagagtctttttgaggaatatctggatgcaaagtattcacattttcagatgaggtcattggatgactatgagaaattaaagaaagtaaataaagccagaagcaaaacccagtcccggtttgtgcggtctgagctgatggatacgatccgggagtactcaaacggagaaagtgcgtttttgtatttttcggaaaagattacagagcaggcattatttttgctggatgagccggaaaacagtctgtctcctgtcagacagcaggagttggtgcgttttattgaggattccgtcagattttacggatgccagtttgtgatttctacccactcgccttttgtgttatccatgaaaggggcgaagatttacgacctggatgaagatcctgtggatgtgaagcattggacggagctggaaaatatcaaagcatattataaattttttaaaaagcatgaacacgagttttcattttgataacgaaggaggaagaagatggaatacgtagtattgggaagaaccggattacaggtcaacaaaaatggttttggagcactgccgattcagagaatctccaaagaggaggcaggaaagcttgtgaaaaaagcatttgagaacggaatcaattattttgataccgcaagagcctattcggacagtgaagagaagatgggagcggctcttgcggacgtacgagatcaggtcatcatcagtacaaagacagcagcgcaggatgcgaaggaattctggaaagatttggaggaaagtcttacaaagcttcagacagactacattgatctgtaccagttccacaatccggccttttgtccgaagccgggagatgggacggggttatatgaggcggctctggaagcaaaagagcagggaaaaatccgtcatatcggtattacaaatcacagaattgcagtggcaaaagaagcggttttatccggtctttatgagacattacagttcccgttttcttatctggcatcggaagaggaaaaggagcttgtgaaactttgtaaagagactaataccggatttattgcgatgaaaggactggcaggtgggcttattcataattcagccctggcatatgcgtttatgtgtcagcctgaatattcccatgtggagccgatctggggcgtacaaagagagtgggaactggatgaattcctatcttatcaggataagtccccaaagcttacagaggaattaaagacagaaatgcaaaaagacaaagaccagcttgcaggagaattctgccggggctgtggatactgtatgccttgtccggcaggaattgagattaacaactgtgccagaatgagtctgatgctcagaagagctccacaagaagcatggctatctgaggaatggcaggagaagatgaagaagattgaagactgcttgcattgcggaaactgtatgaagaaatgtccgtatggtttgaatacaccggagcttttgaaacgtaactacgaagattaccagacctttctttaacagacaggcggaaactatatggactacaaaataagatagcgtaatcacatagggcaggaatcacacgggaattcctgccctgaatttatggtttaataggtgagatcctcgcatacggatttcagattcaggaaattggtgagataatcttttgttcctgtctttgcgtccgtaccggacatattgaagccgccgaatgggtgctgaagtacgaccgctccggtggactttctgttaaagtaaaggtttccaacatggaattctgcttttgccttttgaatgtgagtccggtcttctgtatagacagatccggtcagcccgtattccgtgctgtttgcaatttccagagcctcatcaaaagaattggcacggatgactgcaagaaccggtccgaagatttcttctttggcgatgactgcatcctttgtgatatcgcgtacaacagtcggctcaatatagaagcctttggaatcgtcatagtttccgccaaaggcaatcatgccttccttgcgggccgtctcaatgtatccggagattcggttaaaagcactctggttgatgaccggacccatcggaaaatcgtctcgtccactgccctgatgttctttgagcactttagcacaggcaatgatctcctccacaaacacatcgtacacatcacttaataccacagctctggagcaggcggagcatttttgcccctggaaggagaatgcagaattggcgattccggcggcggcccgtttcagatcagcggaggaatccacgataattgcgttttttccgcccatctcggcaacgacccgtttgatccagatctgtccttccgatacttgggcagctttctgattgatgcgaagcccgacttctttagagccggtaaagtttacaaaccgggtcagcggatgctgtacgatataatccccgatcacagagccggaacccggaataaaattgataactcccgcagggaatccggccttttcgcaaagttctatgaatttgtaagcgacaatcggagtgtcggaagatggtttacagacgatggtgttcccggtgataaccgcagaaactaccatgccagccagtaaggagagaggaaagttccacggcggaacagcaactcccacaccgatcggaatgtagatacatttacaggattcctcggtatacacaagttccaaaccttggtccagctcacgcatatgcatgatgtaggaattgaagaaatccagcgcttcacagagttcaccgtctgcctcgccccagttctttccactttcttcaatactccatgcatcgagtagatagcggtatttcttcatcaggtctaccagcctgcgtacacagcagattcgttcctcgacaggagttttactccatgtctggaaagcgtcgtgagcggtccggatggctttgtctgccagtaactgatcgcaggagctgacccggccgagcacttctttggtggacggggcattggagacgatttttttgtcggtcataatccgttctccgccgataatcagtggataatcctgtcccttttcctggtctacctctttgaatgccattaacattgcttctttgtgctctggaattgaaaaatttaattctggtgaattttgaaatccttttagcatgtgtatacctcctgttgtgaataatttttcatgataataaatattttatcatttgcagtttgacgcgtcaatgctttaatggaagaaaaaccgttaaataatgtacaaatcagagagatacgagggaataattttttattagacaaaaaagatatgagtacgaaaaagtatagttatacaaatatagtgatccgagataaacagaaagaatctgtatgaaagatttacagatagatacagcagaaaaaatatggtacaatcaagacaagagagatagaaggagagcagaagttgaaacgaatacttgtgtgtattgatattggaggcacatcaataaaagcaggaatctgtgatatggaaggaggacttggtgcacaggaaatccttccgattcatcaggatattgaacagttgctggaggagatcggaaagtatgtaaacaaggcaaaagaatcgggcgagatgattgggatcgccatgagcgcaccgggggcagtgaatgtatctacaggtgtaattggaggcaggagcgcggttttgtgtattcatggtctttcctggacagaggagctgacacgcagattccaagtgccttccagtattgaaaatgatgcaaactgtgccgcgatggcggaagtgacattcggaaatgctcgaggatacaagaatcttgcttttgttgtttgtggcaccggaatcggcggcgcagtcgtgatagacgggaaaatctgctgtggtgccaatctatatggcggcgagtttggttgcatggtcatgcgggatcgagaaggaaatctgagtactttttcactccaggcgtctactatgtctcttgtccgtagagtgaaggctgcttatccggctcaggaatgggacggaaaaaaagtctttgaggaggcggaaaaaggtgacgtcaactgccagaaggcggtcgatgacttctacatgaaactttctgaggggatttttaatattcagcatgtttatgatccggagctcattctgcttggcggaggaatcagcagccgggaagattttgcagatcaggtgaaaagccgtcttatagtgattgcaaaagcggtcgaagagaccgccggtacgaaggtggttattcctgtggtaaggacatgcagttaccaaaaagacgccaacctcatcggtgcggcagcggtatttatgcagaaatacccggagttgattggaaaggagaaaaagaatggataaaaaagcaatgtacaaattaagttatgggctgtttgtagtaacggttaaggaggcagaaaaggataatggttgtattacgaatacggtgatgcaggtgacatccacgccaaaccggatttcccttgccgtcaacaaggaaaattacacacatggaatgattgaaaggaccggaaagtttaatgtatctgttctttcggaacaggcgtcttttgatcttttccgtcatttcggattccagagcggaaaagacacggataaatttgctgattttaaacaggcggtccgtgtggagaatggactgtatgtagtgacagagggaaccaatgcgtggctttctgctaaagtcatacaatctgtggatcttggcactcataccttgtttttggcagatgtagaggatggagcagtgctttctgagacgccatccacgacttacgcgtactatcagagtaacatcaagccgaagccgcaacagaccaaaaagaccggatggagatgcaggatctgtggatatatttatgaaggagaggagcttccggctgatttcgtgtgtccgatttgcaaacatggcgcggcagattttgagaaaatctagcggatgtgatttgtaaatggtttacatcgtatccgaattgtacacttgacaaaagaaataagaagggtataatagttcactaagaaacagtttcttggtgaactatttgcttgcgtaaaaacagaggggagtgaagacatgtataattttactgaattctggatgggaattcaaaggatggtacgtctttatgaaaagatgatgagagaagtctgcgatgggtatcggctttctatggtagaggttgatatcattgcgtttttaaaaaacaatccgcagaaggatacagcggcggacattgttgaactgagaatgttgtccaaagcggcagtttcaaagggagcagatgccctgatccagaaaggaatgctggaacgggaagcagatccgacggaccggcggaagattcacttaaaacttacaaaggaggcatttcctgtgacgcgggaaattcaaaaaacccaggaagcctttctgggtcttctgtatgagggattttcggaggaagagtatgaaatgtatcttcggatgagggcgcgaatgttgagaaatgtcagcaataaaacaggagaaagaaggaagaaacatgaatgaggataaggaatttcttggaaaggagccaatcgggaaattactattaagattggcacttccaacagttgcagcacagttgattaatatgttatataatattgtagacaggatttatatcggacatattccggagattggagcaaaggcactgaccggagtgggcgtgtgtatgccgttgattttgattgtctcagcttttgcggcgcttgtcggctacggcggagcgccaagggcgtcgattgccatggggcgtaaagataatgaagcggctgaaaagattcttggcaactgttttaccgttcagattttgatttccgtcattctgaccgtggtcctgctgatctggaatcgagattttctgatggcatttggagcaagtgaaaatacgatagaatatggcgtacggtatatgagtatctatgcgctcggcaccttatttgtggaagtaacgctgggaatgaattcatttatcactgcacagggatttgctaagacgggaatgctctccgtattgattggcgcagtagccaacattattctggatccgatctttatttttggttttgacatggatgtacaaggtgcggctttggctacgattctttctcaggcgatgtcctgcatatgggtcgtatggttcctctgcgggaagaaaacgacattaaaaatccgaagaaaaaatatcgggatcactcccaaggttgttttgccctgtctggcgcttggcgtttcggtttttgtcatgcaggccagcgagagtgtgatttccgtgtgctttaattcttcgttgcaaaaatatggtggggatattgcggtcggggcaatgacgattcttaccagtgtgatgcagttcgccatgctaccccttcagggacttggacagggagcgcagcctattatcagttataattatggagccggaaatatgaagcgggttcgtaggacttttcgtttgctgttgcaatccagtctggcgtattcaaccgttttatggcttctcattttgctgttcccgcaggggtttgcggccatgtttacatccgatccggaattgatgatctttacaaggacagcgcttcggatttatatggcagcctgtgtcatcttcggtattcagattgcctgtcagatgacctttaatgcccttggaaatgcagtggaatctatcacagtagcagtcgtcagaaagtttgtactgctgatccctctgatctatctgatgccaatgcttttgaaaggggatcaggcaaaagcagtttatatggcggagccgattgcggatgtcatcgccgttatgtttacagcctgcctgtttttcttccggtttaaaaagacactggagaaagaaaacgcagagtcgggcggaaagggaaactaatatgaaagatacgttaaagaagttcagtggaagagcggatgattatgtggcgggaaggccggcctatgcggaggagtttgtgcggtggctggctttggaacagggattttcagaagaaacgattgttgcggatattggatcagggactggaaaattcgcgaagcagcttttaaagatgggctgttttgtgtatggaattgagccaaatgatgatatgcgtaaaaaggcagaggagaatttcctaaaaggagaaaatttttgttctgtcaaaggaacagcaaataagactacactgaaagagcatgcggtggatgttgttacatcggctcaggctttccattggttcgatgtcactgcatttcagaaagaatgtcggaggatcctgaagccggacggccgggtgtacctgatctggaatgtgcgggatatgggggaaaaactgaaccaagagacttttgcgatttaccgtacgttttgtccgcggtttcaaggatttagcggtgggatgaaaaaggatgatgagagaatacagaccttttttgaaggacactatcaataccggtcatttgatcaccctttgtcttacacggaagaaacctttattcggagaagtttatctggatcctactcgctgaaagagggagatgtcgggtttgaggaatatttggaagcattaaagaatctgtaccggaaatataatagagacggaatactgacaatggggaatcatacggctgtgtattatgggagactgcagtcttattaagaagaataaaaagttgccaggaggtttttatgacagaaagagaaaaaatgttggcaggagatctttatgattgtggagacccggaattgttggaacaatggcataaagcaaaagatttgatgcgggattacaatcatacggattctgctaatttacaggaaaaggaacggattcttaacgagttattgggaggaagaggaactaatctctggattacagctccattttatgtagactatggcaataatatttattttggtaataattgtgaagtaaatatgaattgcacatttttggatgacaatgagatacgaattggaaacaatgcgttgatagcgccaaatgtacagatctatacggcatttcatccaaccaatgcggctgaccggtttggagaatcaaaagaggacggttcatttgaattttgtaaaacacagacagctccagtagttattggcgataacgtgtggatcggaggaggagcgattctgatgccgggagttacaattggtgacaatgttgtgattggtgcaggaagtgtagttacaaaagatataccaagtgacagtattgcatacggggctccctgccgtgtgatgcgggaaaataagtagcagatttgcgccggaagaaattacaatgacggtggaacagggggggaaaacagaaatgaaagtagcagtgattggatacagtggctgtggaaagtcaacgattgcggcttggattgccaagaaaaatcagcttccgcttttgtatcttgatacggtacattggctgccgggatggaaggagcggcctcaagacgagaaagaacagatgatgaaagattttttggacagccatgactcctgggtcattgacgggaattaccacagtctggaatatgaacgcaggatgcgggaggcggatcagattcttttcctcgattttccgcgtctggtctgcttgtaccgggcatggacacggagccgaaggtaccggggaagaacaagggagtctatgacagaaggatgtccggaaaagctggatctgggatttgtactctggattttacgggacgagagaaccagaaagaaaaaggcagagtaccaacggattctggacgaatataaaacgaaagtggtacacataacaaatcaaagagaactggatgaggagaggcgaaaatggaggaaacattaactcagttatttgcgtttatcaaggagattgataaggaaaaattgataggtcgccagacctatctcacagacgggatgagaaaagaaaatgatgcggaacatgcttggcacatggcggtgatggtccttcttttcagtgaatttgccaacgaaaaaatcgatgtgcttcggacgatttccatgcttttgatccatgatatcgtggagattgacgcaggggatacatacgcttacgatgaggaagccaagaagacacaaaaggagcgggagcaaaaggcggcagatcggattttcgggcttcttacaaagaaccggggcacttttctgatggaactatggaaggagtttgaggcaggggaaacgcctgaggctaaattcgcaagaacgatggacaatctccagccgttatttctcaatgcatgtaccgaaggaaaagcgtggatggagcatggggtttctctggatcagattttgaaaagaaatgacagaactgcggaaggatctgaagtcctgtggaattatgcaaagaaacactggattgaaccaaatctggaaaaagggagaattcagagggggaaagatttgtaattggagcaaaggtgcgttataatgaaaagtcaaaatgaaagggatacggttgaacagaccatatccctcctttcttcttaaaactgtgtttccaccagattggatagtggagcaatatgatatcccatctgctcccacttcgtcaggagttcatccagaatctgtgcgttggtggatgaggtgttgtggagcagtactatcgcaccgggatgaattcggccaaggagcttttcaaaggcttcctctttggacggctggtcgttttcataccagtctacataggcgagactccagaaaaaggtgtaatatcctagattttttgccatttccaggttgcgcgtgctaaatttcccctgaggaggacgatagtaaggactcattttctttccggttgtcttctcaaagagtgtttctacactttccagttcctcatggaaagagtcttccgtggatatggaggacatgtcagggtggtgccacgtatgattgccgacagtgtgcccttctgttatcatccgttttacgatctctggattgtcacgcagaaatgtgcctacaataaaaaaggtagccggagccttatgctttttgagtgcatccagaatctgaccgctgtttccgttttcgtagccacagtcaaaggttaaatagatgaccttttcttttgtgtcctggcagtaggcggcattcaaggtggagagctcggaaatttcagcgtttccgatagggcgttcgccctcttttggaaaactcagtccccagttttccgacgcctgggcagaagtttcctgtgtttctttcgaaggatttgaagaaaacaggataccgattccggttcctacgcagtaagcggcgacaaaaagcaagagcaaaagagcagctttttttaggttgagacgatgtttcataatgtttgattcccgaagtcactgttgatttcagtctatgtcatggacaaaggatttagaagtacggatggaagtaagaacgaaaggtggtggaaatggtaacagttcatccatggcatctcagaattcactgctatgatttctagttgaactgttacgaagaacatggaaaacagaacgttttattttgctcccctggaggggatcacggattatatctaccggaatacctaccaccgtttgtttgagccgatggatgcttattttattccgtttttgacgccagataaaaacggaaaattgtctaggcggcagcgaagagacgtgcttccagagaacaatgaagggctgcatgtcattccacagattctgacgaataaggaggaggagtttttaaatggtgcccgacaactggaagaactcggataccgggaggtcaatcttaatctaggatgcccgtctcgatgcgtcgtctcaaagggcaggggggccggatttctgggagatgtggagaagctaaaaaggtttctggatacgatcttttccgggacgaggatgaggatttctataaaaacacggattggggtagaggatccggaggagttcggcccgcttttggaagtatttgacctgtatccgatttccgaacttatcattcatccacgtacagcgaaagaattctataccggaacggtacattgggaaatatatcgatttgccagggagaagagtagtctgccgctttgttataatggggatctgtttactctggaagaatatgaggcgtgggattatgcatttccaaaaagcagggcggtcatgtttgggcggggcgtcctgggagatccgttattactttccagaatccggagaacgaagggaaaaacggcgacatgggaagatcttcagtatgagctgtatgtcgcataccagaaagagatcggaaacgaacagcacgtactctcgagactgaaagaattttggacttatcgtgcgctttgtcgccctgaggagcgggaaaagatccggcagatctatcgaacggagacattgcaggaatacgcaaagcgattgcatttttagcatctttataatgacaaaaagagagggattgccatgagaagcatgagattaaaaaatcgggaaatcaaagatcaggagacactgcgggagctgattgacgactgtgtggttgtgcggattggagctatggataaggaaggaatgtttattgttccggtcaattacggatacgaatgggaggatataaaagacagtgcaccatccttaaagttgtattttcattctgcgtcacaaggccggaaagcggacgctttttcccgcgaaccggttgtcgccttggaactggaccgggaaggaggtgtcatcagaggaacatatacctgttcttattcttttgcttatcagagcgtcatgggaaccgggaagattcggaaactgacagaagccgttgaaaagctgcatggatttgaaaagattatggaacatctggcgccagaggccaagcatacgtttgatgaaggacttttgaaggcggcggatgtatactgcattgacgtgctgtccttcacaggaaaagagagaaagccaaaagaaacaggacaaagtgagaacgtataggaaacggaagctttgcatatattgccagtaaaacaagatgtgcggtaaacagatggggagcagacgaagaaaccagaacaggcaggaagagacgcgcgcagacgggatccggcagaggatcgcggagacggcaaatgcaccaaaagatgtgattatggggcttccgttgatccatctgaccggacagtgtgaagtctccatagaaaattaccgggggattcaggaatatacccaggaattaatccgggtgaaaacaaaagccggaacgatccggattaccggaaaacgaatgtgtatagaatactatatgaacgatgagatgaaaattaccgggaagatctggaaggtggagtttgaaaaaaaggaggaggcatattgctgacacggatcctgcggtatataaagggatatgtccggatacggattaccggatattctcccgaacgatttctgaatctgtgcaaatacaggaagattccggtctggggactgttaccgggccgtaatttttatgatatgaatatcacgattgccggcatgaaaaagctcaaaccgattttaaaaaagaccggcacgaatctgcgaattcttgaaaaaaacggtcttccttttttcctgttccggcaccgtaaaaggaagattttttttgcgggggcttttggatgcatcgctctcgtatatatcctttcccttttcatctggaatatcgaaatcagcggcaactatgtccgaacagatgagacgattctgtcatttttgcgaaaacagaatgttcgttgcggaatgatggcctcttcggtggactgtgccgggattgcccggatgattcgaaaagaatacgacgatattatctgggtatcagcttcgctaaaaggaagccagatccacattgacgtcaaggaaaacagcgattccagagaaatcagtgaagaaaatccagtggaggagggaaacgatctcattgcggaaaaggatggtatcatccaggagattgtgacccggtccggcgttcctatggttcatgcgggggatgaagtgaaggcgggggacctgcttgtgtccggacgcgtggagatcaaaaacgacagccaggaggttgtaggctatcagtatgtgaatgcggatgccgacatcaagataaaaacaaaggaaaactatgaggatgttttggacctatcttatacggtcaaaaaatatgaaaagcagaaaaaacgccagattttcctccggacagcacaaaaagaatacacgctggggcagaaagttgaggagggaaaaggacgggaagtatcctcctcggagatccgtccagggttttccttaagttttccatttccattttcctttgggatccgggaggaagtatcgtatcgagaagtgaaaaaaacgtactcaaaaaaagaatatcaggagatcttgagcttggaatttgaccgcttctgtgaggatttaagaaaaaaaggggttcaaattcttgagaataatgttaaaatatacaaggacacgcaaagtgcaagagcaaaaggaacaatgattcttctggaatcatgcggaaaggaaagaaagatagaacatgggaatcttggagagaacaatgcagataccaactgagcatgaagcgaatgtattcggtcagttggacacctatgcaaagaagatagagcgcacgttccatgtgacactgatcgagcgcaacggcgagatcaagatcatgggggaagagggcaggacgaagagggcacaggagattctggaaaagcttctggaactgtcccgcagagggaatgtgattaccgaacagaacgtaaactatctcatctcgcttgcaatggaggatgaggcgggcgatgttctggagatggataaagaagtgatcgcctatacggttcaggggaagcctgtcaaggcaaagacgctgggacagaaaagctatgtggacgcaatgaaaaaagacatgattgtctttggactcggccctgccggtacaggaaagacatatctggctatggccatggcaatcgcggcatttaaaaacaatgaggtcgcaaggattattctgacgcgtccggccatagaggcaggggaaaagctcggatttcttccgggggatcttcaaagcaagattgatccgtacctgcggccgctgtatgatgccctttaccagattatgggagcggaaagctttctgaaaaattcggagaaagggctcattgaggtggcgccccttgcttatatgagagggcgaaccctggataatgctttcatcattctggatgaggcacagaatacaaccccggctcagatgaagatgttcctgacacgaattggctttgggtcgaaggtcgtcatcacgggagatgagacacaaaaggacctgccgtcgggacagacgtcgggcctggatgtggcggtccgggtagtaaacggtctggacggcatcagcatctgccacctgacaagcaaggatgtagtgcgccacccgcttgtacagaagatcgtcaaggcttacgagaattatgagaaaaaagaggaaagccagagacggggaaccaggagaaaaagtaagaaatacagaggttaatatgacgatatatttagaagaagaatctgaaatccggcttccggttgactgccggaaagtggcagagcaggttgtggaggagacgcttgattatgaggaattcccttatgaagcgcaggtcgagatcctgctcacggacaatgaagcgattcgagagatgaaccgggagcaacgggggatagacagaccgactgacgtactgtcatttcctatgattgaatatgagacggcgggagaatttgattttctggagaatcagccagagtgttttcatccggaaagcggcgaagcgcttcttggggatatcgtgatctccaaggaaaaggtaatctcccaggctgaggaatacggacattccccccttcgggagtatgcctttttgattgcccacagtatgctgcatctgctcggttatgaccatatggaggagcaggagaggcttgtgatggaaaagaagcaaaatgaaattctggagcgcctggggatttccaggttccaaactgcaaatgagaaaagataatagaggggtgttttatgggtaaaaagaaaaacggaaatgagtttcttgtgcagggaggaattctggcggcggccggaatgatctccagaatcataggaatgatctaccggattcctcttttaaacattatggggacgaccggacaggggttttatgaggtggcgtatcagatctacagtatcgcgttgattctgacatcctacagtatgccgcttgcggtctccaagctggtttcggccagactgtccaggcatcaggaaaagaacgcataccgaatctttaaggcggcgctcctttttgccatcgttgttggaggcggtatcagcctgatcattttcttcggggcggatttgcttgcgggaggcgtgatgaagatgagtatgagtgcctatgcccttcgggtgctggcgccgggacttgtcattgtatctgtgatgggtgtgcttcgaggatttttccaagggcagggatcgatggttccaactgcggtatcccagattctggagcaggtgatccacgccattgtcagcatcattggagcatatgtcctgcttcagtacggaaaaaccgtcagttccgatcagagaaatgatctctacgcaccggccttttccgcagccggagcgactttaggagtcattatcggaggcctgattgccctcctctttcttgtgctgattttctatgcgtacaaaggaaagctgaacaagagaatccgcagggacaggacaacgcgtcaggagagctttggttttattttcaaggtactgattctgacgatcgcacctgttattttgagttctactgtttacaatattcagaatgtcattgacagcgctatgttcagcagcattatgtctgcacagggattttcagaaaagcactgtgccgctttgcttggaagtctgggacagtactatacattgtttaatgtgccgctctttatggcaaacgcgcttggttcgtctatcgtgccgccgcttgtgcgtgcctatgagaagcagaacaaggaacaggtacatcagaagatcgagatggcaatgcgcgtgacgatgctcattgccgtaccaagcgcggttgcgttttttgtcattccaaagccgatgctggatctgatctggggttccatcgataacacggtggcggcaaatctcttccgtattggatcgatttccatcatcttctatgcggcatccacactgaccaatgcagtgttgcagggtgtcaaccggatgatggctccagtaaaaaacgcggcgacatctcttgtgatacatattgccgcgctttttgtgatgctggtattcttccactggagtatctatgcggtagtagcaagtaaggtaatctttggtctggccatgtgtatcctgaactcacacaatctccgggaggcggtcggatatgtgcaggagaagaagagaacctttgtctacccggcagtagctgctgtgatcatgggcattgttgtctttgtgctacaatttgttttggcgctggttatcagcagcgcgattgcgacattgagtgccattgtagttggaatttgcgtctatgggatcagcctgctcgcgatcggcggcctgacagaagcagaaatcctggcacttccaaaaggagcaaagattgccagaatgttacagaaagtacatttgctgaaatagagggtgattgatgaaacgaatgttattgatccatgatttgtgttcagtaggaaaagcggccatgatgaatatgattcccgtcctcagcgtaatggggatcgaagtctgtccgcttccgaccatgctgttatctacccataccggaggtttcgggaaaccggagatcctcccggtgccgggaaactatttgaaagagagtctgcggcattttcaaagagagaacatcacgtttgactgcgtgtttgtaggatatctgggaaatgttccgatggtagaaacggttttggagcttttaaagacagggccggcgccttttgtaatctgtgatccgattatgggagatcatgggaagtactattccaattttgatgacagctatagagaagcattgtgcgctcttttgggggaagcggatctgttgcttccgaatctgacggaggctgctttattaagcggtgttccttatgaagaagggatgacgggggaggggcttcatgctattgtctcccggctttgcgagatggggatgaaaaaaggtatcatcaccggaacgaatgtaggagagcacaggatcggaatggcgattgttgagggcggttttgtagagcaatacacagagaccgaagttctgtaccaatcccacggtacaggtgatttattcgacgctgtgcttgccggagcaatactaaaaggggcgaccttgaaagaagcggcgtttcaggcacataactttgtggcggcctgtctgcaggaaaaggcggggcaagcaggaaacgaaagagacggcctgccgttcgagcagcttttgggaaaacttgtataatttaaaaaaaagagcagatactgtatgaaaaaggagtgtgcttctatgaaaaaatacagtatcgggctttttgctctttttctcggatgtgtagccctgatcggggcggcttaccagttcagttttgagtactccaaaaatcaggcgaaagaggaggccagattaaaacaggaaattgtgcaggcggccagggaagaggaggctgccatagccgctgaaggggacgtcagtaaggaggaagttttttatctgaaagatttgaatggctttattgccgtctataagtcagataaaaagacgatttatgagtataccaatattgtggtggaggatttgccggaggacgtccgtcaggagatccttgatgggaaagagatacggacggtggaaaaactttacggatttctggagaattattccagttaattaggaaaggtacaagaggatgaaagaagaaaagatcaaaagaatcaacgagctttatcataagtccaaagcagaagggctgacggaagcggagaagaaagaacagaagattctgcgccaggaatacatcgaggcgtttcgggagaatctacggggacagcttaatcagatttccatcaaagaaaaagatggaacaattatcaatcttggtgaaaagtatggaaaaaaaagaaatcagaaaaaaggttcttgatatcagaaacaggataccggcagaaatacggagacagaagagcatggagattacagatcgggtctgcaagatgagctgttttcttcgtgcgtcttcaattttaatttaccggaattttcgttccgaggtggagaccgggatgttgatcgaggcaggatgggagatgggtaaggaagtcttctgtcccagggttgagggaaaggagatggagttttaccgggtgaagatctgggaagattttgaaagtggtgcttatgggatcagggagccaaaggccgaatgccctgtcttcgaaagccagtcggatgacaaggttctgatagtgcttccgggggctgtgtttgataagaaaaggcaccggatcggttacggaggaggattctacgaccggtatctggaacagcatccccaaatgcaaactcttgctgtctgttttgaagaacaggtaatggaagaagtgccgtttgcattgcatgatatccgtcctgcaatcattgtgacggaccaaaagtgttacgagtaggaaaaggatgtgagagaagatggcagacttgccgaaagatccggcgatgcttcttagcatcgtcaatatgaagctgagggatttctacccgtcgctggacgttctgtgcgacgatctggaaatcgaaaaagatgcgatttgcgtgccgctgtccggtatcggatatgaatacgacgaaagacaaaatcagtttgtctgaaattttaagaagattgcgtgaaagagcgcagtcttttttcttgcttttttagaaagagcgtgatatactttaaacatttctaagaggggcagatcgttgtcccgttctgattgttctatttatctatattttctatattcgagaccgaaacatgatccgtttcggagatccagatttaaaaaaaacttcatgtttggagggggtgaggcctttgattgactgaacacatatgatgcagccagaaaacaagacatggaggaaaacgtatgaggaaaaaaagaatagggaaacaggtgatgatcattgtgttgcttgtcgttgccgcgacagccacagtcagagggatttctgcctatttcacagatgcccaggaaaagacaaatacactgactgtcggaaacgtcaaaaccggactagaggagccggactgggacaaagtaccttctgatgaaaagaccgacctgactccgaatcagacagtgaaaaaggatccgaggatcaccaataccggaacaaatgatgcctacgccttcctggaagttcagatcccggtgcgaaatatcattactgtaggagcggatgggaagaaacttcctaaagcagacacggagctttttacttacaaggtcaatgacggctgggtacagattcaggagtcggacgtcagttcatccggtaaggtgacagcccatcgatatatctatgcctatggaaccgaacaggagtgcaaagttttgaagaagggcgagacgacgggagcactttttaacagtgttaccttggccaatgtgatggaagggcagattgacgatgagacgctcaatattccggtgaaaagttatgcaatccaggcggagcatatcggggaatccaaagcgccatccgatatctttcaagtttatctgaaacaaaattcataggtgggaggcaggataacaaatgaaaaagagaaaaaggaatctctgtgtgctgcttttgtccattctcgtggcagcagcatggagtgcggttgtactgaatgtatcggcttatttctcccatcagaatgagaagaacaatgtcctgaagaccggggataatacatcgcatattgaggaggaattcgaaccgccggatcaggtgacgacggatactgtttatccgaagaaagtgacggtgaaaaacgattcccatactccatgctatgtgagggtgtttgtggagttggatcagcccaatcttccggtttccatagattttgatacaaaaaactggacagaaaagcaggcggacggatactattactatcgcagcatccttggcggaagggaagagacgaagcctttgtttacccatgtgacgacagaggggacacagagcgcgtttcgcgtcttgatttatgaggagacagtgcaggcacagggatatgacacggcccgggaagcgtttgcttccatcaagggagaacaggaggcagaagcgtgaaagtaaaacggtggatcacaggaattgccgccgtcatggcggcggtctgttttgaaatgcttcccgtacagggagcggaacatgtcagcgcccttgaggcttccagggaagagggttcccctatcacggtaaagaaatacggggaagaggaagactcagattattccttccggctgaagcggacagacagaagtacctgtacttggacagatacaagcggagtttctaatccgaagcgttttcagcagacgggacaaggagtggaacggtgggggcagatcgtgacaagcgatacacaaaaagggaaaatctcctgttatttgactaatatgggcagctataaagggaagaataccaatcttcggattacctttacggactgggatgtgtatcgcactgaagaggggaaacggtactatcctcttctgggagtcgcgttttcaaagacagtagacttctatgggcttttgtttagcgacatctggtatgaagcaaaactggagatcttggatgatcagggcagacccctcgctgtagatatgacataccgggcagaagatttggattatgggcaaatctttggagtgaaaaaaggagaccatccggttggaatttccgttccacaggacagtagagcatattacatcgaacgggatgggttttattacttttatgcccagaatgtgaattccgaggaatatgataaggacagtgtacaagtccaatataaaaatacatcctctttttccctgcgggtaggaggaggagtcgctttcccaggcagttttacctatagtcaatatgtacctgagaaaatcaagaatgattatgagcgatttgaacattatctgatcggagaaccaagtgcggacgtatcagatcagatgggggcgctgattgggtggatcgccggttccgcaaaaggatatggtccttttacacctccggttccgacgaagcttgtggatcgggaagaagtacatggagaagaaccattcacctattttatcaactttaaagtaccggaatgtcagcaggcggattattatcaaagtctgattctaacggatccggttccagaaccgcttcatgtggatcaggtcaaagtgtatgacgcggataatcagacagatgtcagttcctatttttctattcagacgtcagaaggaaccggcaatcaggtacgggtatcggtgagagatccatcgacagactggatgtatggacgcgcctttgagatacggattcaggtacataaacgggaagactatacattcggttcctctaatatcgtttctaatcaggcatcgcttgcggtagatcaaaattcaccaaagaagtcaaaaacagtacggacttcattctattatcaaatcacaacggaggctgaaaatggctccattaccgcctccaatctgaaagttcccgcaggaggaagtatgcggatttcttacgccccattgacgggatactatctgaaatccatcacagtggatcaaaaagtgattgataagaatcagcatctcttagattattcctttacaaaagtcaatgcagatcaccatatcaaagctgtatacgaaaagaatccggtagtgacaatcacaaaagaagtgaccggaaaatgggaggactttgggactccggtttttctgtttcaaattacaggaactgattataacggggtcagacgtacctactacgaatctctggagatgccggaacagtttcagacgggacagatctatcggaagtcttttacaatgaagattcccgctggtatgtggacggtgcgggaaatcccggtttcccgttatgcgctgaccggtatccgggaagtggaaaatggagaggtggagggagagaaagttatcctggatacaaaagaccacgatacggcaaaggccactttctgcaatacgctgacgaactatagtgagttcagtcacaatgatgtcgagatcaatttctttggaaagcaggtgggaaggtgaagaaaagaaaaagacgtatcatagctgtcctgttgtgctggatgctgtgtggtacgactgcctccggggcagtacaagaaggggaagtgacgactacgattcgttctggagaagtccggatccggatgcatcgctatggagacgagaaaaaagaaaaggggtgggaagatctggaacatattctgccgggacagaaaattacgatgatcacggagattgaaaatctgggtgagaattgcctgatccgttatcagatgacggcggaagcaaaaagtaatcgggagattccgatctcgtccttttccgggattcccggtaactgtgttcgcaaaggggagtatttctaccataccgatgtcgtaaagcatggagaaacggtgagactttttacagcatttactttaccagagacctgggaacagggaggggaggatgagatccggattcatgtggcagcagacgccattcagagccgaaattttacgccggattttacgtctgagcatccatggggagatcaggtcattcagaaagtatccgggaaaacgggcgaccagcttcggattttgacaccccggaaaggaacgtgccgggtcgtgctggaaggagacgacatcataacagtaccggacacgtttttcgcagagtttggaacactggttccaggagatgtcatccaaggagaacttcagatcgataaccggagcggccggccggaagatgtatactggaagctggagacagaggaagaacttcttctggaacaggcggaactttgggtggaaaaggaagatggtacggttctctgccaaggaagtccttcggaacaatccttggggcaatttgctttccttgaaacgtatgaacaaaatgagaaagaaaatctcatattctttctccgttttccggaagacatggataatacataccgtctgcgggagtccacacttacctggacgtttcgggcagtgtcagaggatactacggttccggcaggacaggagtcggtcaaaaccggggagaacagtcatgtaattctttatggatgtatggcaggaggcgccttactgacaggtatccttctgataaaaaggcggagacgacggcatggataaatggtttcgaagaattgatacgctgctccttttgggcgcgctttcctttgtgctgttttttgtgatgcctgcttttttcggaatccgtccagttcgtgtgttgtctggctctatgaagccggaaatcgttgaaggagatatggtctacattcaaagctgtcgggaggaggacgttcagacaggagatgtgattgcgtttgagaatggaaacggacagatggtgttacacagagtcatacgaagagaagaagaaggatttattaccaaaggagatgccaatgaccgggaagatttccaaccagtatctgcggaggatctcatagggattctggccgttcgatttccaaaaggatcctggctctatgaaatgatgagttccaaaacgatgagaagagtgctgcttctttctgggcttgtccggatcgtcgtgtatttttttcgccgcttttcccgttaagtctgtcgtttttgacaaaactgcggtatactgttcccagattcgttcctgtacaggaacgcaggtgaggaggaaatggttgaaatgcagtcgtttatcttggaaatctgtgtggactcagtggaatccgcagtggcggcagagcggggcggggctacgaggttggagctttgccagaatcttatgatcggcgggacaacaccgggaatcaagctgtttgaggcagtaagagaggagacacatattcccattcaagtactgattcgcccaagatttggagatttctgttatacagactatgagtggaggattatgaaagaggagatcaggatgtttcgtgaccggggagctgatgggatcgttattgggatgttgaagccggacggaatactggaccgggaccggatggaagcgcttctggaagagcggggcggcatgtcagtgacccttcaccgagcctttgacgtgtgcaaggaaccgatggagactcttgcggtggcgaaaacaatggggattcaaacaattttgacctccggacagaaaaatacttgtatggagggaacaaaattactggccgcgctgcagcaggaaagccaggaggaaatctgtattcaggccggcgggggcgtcacgccggaaggaatcgaatcactttaccgccagacgggaatctgcgcctaccatatgtcggcgaaagagaagctcgaaagcgccatgacataccgaaacaggaatgtccatatggggcttgcgaagctgagtgaatatgagatttaccgcacctccggtgagacggtgagaagggcaaaggaagttttgaagcggctgtgagatgaggcggcagacagaacaggattataggaagaggcaaaggagaagaaacaaatgtttttagaacacagccgaatgagaattaaagaatcatatgagaaggtaagacaagatttgggagcgatcctggatccggttgagctggtgatccgaacacttcctgaggaagaagcttttgccatgcggtatctgtacgcgtttatgccatacagcgatatcgcaaacaatccggtggagacgtacctggactttgtacggcatggcgtgcgtctgtatgaggaaaaagaggaggtacgggagctcccagaatccgtttacctgcaatatgtgttatttcatcgggtcaacgaggaagagatccgcccgtgcagatcactcttttatcatcagattcaggaacagatccgggggaaatcacctcttgaaacggtactggaaatcaattactggtgtgccggggaggtggcttatgaagcgggggatgaccgcacattatctgcgctgtccgtctggaaaagagggtacggccggtgcggagaggagtccgtctttgcggtcaatgtcctaagaagcgcgggtatccccgcccgtcaggtttatgcgccgtactggtcccactgtgatgataatcatgcatgggtggaagtctgggtggacggaaactggcattatcttggagcgtgtgaaccggaaccgcttctggatctggggtggtttgaatatgcggcttccagagccatgctgattcatgcccgtcgttttgacggggagaggaaagcgtggaactacgatacagaagagccagagagtcttcgggaagaagagatcggatcagagggcatggtgaccatggaaaacgagattcgcaggtacgcagatggagttcagacgttggaagtccttgttttagacgaaaagggacggccggtttcggatctcccggtttcttttgaagttgtcaactatgccgcgttccgtccgattgcaaactgccatacagacatggaggggaaagtgcggctttcctgcggagcaggaagccttcatctgtattgtggacggcaggacaaagcggcagaagagattctggatacaaggagggacagccgtataacgctgacactgcaaagaaacatagaagaatactcttggcaggagtttgatatgattccgccgtctgaccggactccggtggccagacgaccggatgctgcccagaaagaggaaggagcaagaagacttgcggccttgcggacccggcaggagagaaagcgaaaagcgtgggaaaatccggacagaaatgtatttgtgaacgaacaaaagagaaaaagtgagaaagaacagaggatgggaagggcacttctgaagatcctgacagcaaaagaccagacagacgttcggctggatgtgttaaaagaccacctgagtggtgcgatgctttatgcgggtacggtaccggaagagatatttataaaacatatgttaaacccaagggttgaggacgagattctgacaccttaccgaaggtggtttcaacatgaggtgccaaaagaagcgcaggagcgattccggaacaatccggaatccttatggacatggatttgccaggagatccgggaatgtccggagcatgaacggagtactgttttgacaacaccggctgcctgttttaggatacgatgtggaagcagaagatcaaaagcagtgctatatgtagcgatggcaagaagctttggaattgcggcaagacttaatgaagcggacgggatgccggagtattggaagcaaggccggtttatggcggcagatcctaacagaagaaaagactgtgtgcttgttttgagagccgaggaaccaggaacatggcgttattctcagaactggagtctcaccaggatatcagcaacagagcagaaagttcttcgtctgagggatgagggatggaaaaagcaaaagaaagagatttttctggaatccggtacctaccggctgatgacggccacccgactcccaaacggaactgttcatgcagcggcttgtcagttccttcttactccaggagaacatagggaagtacagttacagtccaggaaaagtaatttgatggaaatactggaatccttatcccttccggagtttgaggtccataaagaagatggagacaagtgttcttcacgggtactcaccggtgacggagcccatgtgcttttgtggcttaaagcaggggaagaaccgacagaacatattttgaatgagatgatccaagaacgagaacgatttgaggattgggcttcgcgtatcctgttttttgtttcatccaaggaagcatgggagcatcccctctttgagaaaatcctacgtctcttcccagatatcagggtgttttatgatgattttgaggagcatgtaccttctgtcggacgaagactgtatgtggatcacgaaaagcttcctcttcttgctgtgacaaggggagaacagaacgtaatctatgcgtcaagcggctatcaggtaggaacagcagatcttgtccttagaatcctggaggaggcatcatagtcaaatgggtaacagttcagccatagcagctcggattagccgctatgcggcttttatcgccatttacgtggctacatcctcgctgatggtagaacgccatatacaaagtacacaaaaatcttcgttttcaaacaagttggaactcagatttttgtgactttgtacatggctgaactgttacccaaatgggacaaaaaataatcaaaacctgttgcattttgtcggcaggcatgtataattaaactcagttcgcatatttttaacaaaaagtatagtaatagaaaaccggaggtgcgataggtggagattggaaagaaactcaaggagctacggcttcagaatgatctgacacttcgggatctggcatccagaagtgagctgacgaaaggatttctctctcaggtagagcgtgggcagacaacgcccagcattgctactttagaggatattctggaggctctcggaagtaatctgtccgattttttccgggaagaggaagagacacagattgtatttccgacacaggactttttcgtagacgagcaggaacattatacgattgagtggattgtcccgaatgctcagaaaaaccagatggagccgattattctgacgcttcattcccatcggaaaagtcaggtgatttcctcatatcagggacaggagtttggatatgtactcaagggaagtgtaacgattgtacaagaagggggcaggaagtacaaggtaaaggcgcaggagacattctatatggacgggtcaaaaagccattatctgtataatcacggtgcaggcgatgcaaagatcctttggatcacaacgccgccggtattctaggaaggagaaatgagatggaagagaaaaaactgatcgagtttcgcaatattgtgaaaagttttgacgggcagatcgttctgaaaggaatcaatctggatatttttgaaaatgaatttgtcacgcttctgggtccaagtggctgcgggaagacgacgcttctgaggattctgggcggatttctggatgcggatgaaggatctgtgatttttgacggagaagaaatcagtaaaaaaccaccttatgaaagggaactcaatacggtattccagaagtatgccttgtttccccatttaagtgtgtatgaaaatattgcgtttgggctgaaaatcaagaagatgagtaaagacattattgaccagaaagtgatgaaaatgctcaagctgatcggtttggaaggatatgaagataaaaatactactttactttccggaggacagcagcagcgtgtcgccatcgcaagagctcttgtcaatgagccaaaagtccttctccttgacgaaccccttgcggccctggatttaaagctgagaaaagaaatgcagtacgagctcaagcggatccagcaggaagtcggcatcactttcatctttgtcacccatgaccaggaggaggctcttaccatgtcggataagatcgtggttatgaaaaacggagaaatccagcaggtgggaacaccccaggatatttataatgagccggcaaaccggtttgtagcgaatttcattggggagagtaatattattccgggtgtgatgcttacggattataaagttcggtttgatgatattacctttgactgtgtagactttggattcaaggaaaaagagcctgtggatgtggtaatccgtccggaggatatcgatatcgtggatgtcagcgcaggaaagatgacaggagaagtactcagtgtcctgtttaagggagttcactatgaaatcatggtggagacagtgccggggacaagtgtaaccgtcaatatgagagtgatccgtaatcacgacatcaaaagtgaggatggcaaggagatgatcagtgccaacgatttttatgtggatatcgatgatgtagaagagctggacgataaggagattatcgccctttccaacgcccaggcgtgggatccggacgcggatgaattcatctccatagccaaggtagagtatgagctttccaaggaagagggacggtatccggttactttctccacatctaacgggacaagtattgagaagagcatctatgtagtggatcagccttttgtcaaaaatgagaaagcgaacgaaggtgtcatggcgtttaattttttcaagactgtggatgagatcacggaatctcaggcactcgatacggatctgaagacttgggcgggcgctcaggcatggaaactgagtaatgaagatgaagctgtcgatctcagcgttgactatgattttgagccggagaacgtgaaagagggtgtctaccagattaccttctctaccacaggacgagagtttaaaattcacaccacggattataccgaggaaggacaggaggtagggcttacctttttcccggaggatatccatgttatgtccagggaggtattttaaatgaaacgattttcaaaattggcgattccctatatcgtgtgggcggcgctgatgctgatacttccgatggcattgattgccatgtattctgtcatggagccgggaaacagtatagtttctttctccctgaccctggatcattatgtcaagttttttacggatccggatttccttttgattttatggcgatctcttgtcattgcggttaagacgacggtgatctgcctgattttaggttatccggcggcttactttatcgccagaagccgggaaaagctacagaatatcctgattctttgtattacgattccaatgtggatcaatatgctggtacggacatatgcttggatcggacttctcagtgaaggcggaatgatccagcgtattctcggatttttcggccttggaaatgtagaacttctctacacagagggctcggtacttcttggtatggtgtacaatttcctgccatttatgattttgcaaatccagacgtctcttagcaagatggatccttccttgctggaggcaagtgcggatttgggagcgagtccggcacagacatttcggagagtaacgcttccgctttctctgccgggagtcattaatgggattacattggtattcctgcccgcggtcagttcctttttcattccaaaacttctgggaggaggacagtacttcctgatcggaaacatgattgagaatcagttcatcactgtgggagaatggaatttcggaagcgcgatttctatgattatggcggtgattatgatgctcctgatgatgcttgtccgcagaattgaaactcggaatcagggtggaaagggggagaaagcatgaaaaagaaaaatcgtatctttggaaaagttctgatggttctgatgatcgcgtttttctatgtgccgatcctctatatgatcgtcttttcctttaatgatggaaaatctctgaccagtttcagcggtttttccctgcgttggtatcggcacatgctggagtcgcaggatatgatgacagctttatatacgacatttagtattgcgatacttgccaccatgattgcgaccgtagtgggaactgtggcggccatcggactgtccagctccaggaaagtgatccgcaatctcatggaacaggtgaacaatcttccgatgatgaatccggagattgtaaccgcaatcgggtttatgctgctgtttatcacttttaaaatagaaaaaggatatgtgacgatgcttttggcgcatattgctttttgtattccttatgtcatgctttccgtaatgccgaagatccgttctttggatcccaatctggcggatgccgccatggatttgggagctacaccgtttaaggcgctcacgaaagtaatcgtaccccagatcacaccggggattctttccggggcactgattgcctttactatgtcagtggacgattttattatttcttatttcgtcacaggaagaggcgtgaaaaatttaagtattgtagtctatactatgagtaaacgtgtcaacccaagtatcaatgcagtctctacgctcgttgtggtgatcattacgctcgtacttctgatgattaatctggtacctgtgctggcggcaaagaaaagccggaagaccaatgcaatgagccacagacataaactcattccggctcttgcggtatgctgtgttgtagcggttgttgtggcgacattaaaacacagtagtggcggagcggatcgcccatttgagggacagacgcttcatatctataactggggcgaatataccggagaaaatattatcggagactttgaagaggagacgggagcaacggttgtcatggaaaactttgactcgaatgagcagatgtatatcaaggtggcgaatggagaagcatacgatattctcgtgccgagtgattatatgatccagcgtctgattgaagagggctatttacagaaactggataagtccaagttggattgtttcgataagctttctgaggacgttctgggactgccatacgatccggacaacgattattccattccgtatttctggggaacggttggaatcgtctacgacaagacgaaagtggatctgaaagatctggaaagagaaggatacaatatatttttggatcagaaatataaaggggacgtctatctgtatgactctgagagggattcctttatgatggctttaaaggcgcttgggtattccatgaatacggaaaaccaggcggaactcaatgaggcatatgattggcttgtaacatgtgtagaaactatggataccgagattgtcacggatgagattatcgacaatatggcgcaggggagaaaggcgcttggcctgatctattccggtgacgcaagttatgtcatggcggaaaacgaggacatggggtactatatgccggatactggaacgaacctctggtcggacgcgatggtgattccaaaaaacgcaaagaatccggagctggcccatgcgtttatcaattatgcaagcgactatgacggcgcttacgataattccggttatgtaggatatacctcgtcaaatcaggaagttatggatgacctttccgggaagggaggcgactatgaaggaattaatgcctatatcccgcggacagataatgaaaatgatgaagtttttgtatacaatgcagaaacaaaaaagattatcagtgatctttggagtcgtgtgaagatcgctgccagcaacgctgggtaggaccggaaaagaatgaccagattttgaatcaggattatagaaacgaaaggcctgtcgtcttgctcctctattggaggaatacgacaggccttctatcgtgatatcaatttaatagttaaataggaattttagctattcatgtattttcattacttgcaggtttcatttttccattttctataattatatattgcttgaataagcagcataattgccaatagagttgcaactaagcatgtctgaaggatggattggaatgtagtatgaaaataaaaaataataacaatcgctatgggaatcatccataatgttctaataaattttcttctataacttaatttccaataacataccatgattcctttatcaactttttcagacatatcccatttttttgacagtaataaagaaataactacaagtataaatactggaaatactattaatactacttccgccatgaacacacctccgtatttatgttattatactacttttccgtaaaatcttacggtatatccggttagatattcgtaaaattcaacttttaaagaacacggaattgatgaagaaaaactcatattgcctgtccaagacagtatgtggtataatcaaatactggaagttaaatataaaaaataaatacatcttatactatatttagggaaagtgagcagctaagaatgatcgatcaggagaagtggagtacaattctggaagagtacgagcatctggatgtggcgccggtcacagagccacagcggcagtactattttataaaaaaatgccaacagtatgtaaaacaagagagcgaagaactgggccggccattgtattgtaaaattgtgacatttggctgtcagatgaacgcaagagattcagagaaactgaccggaattctggaggagatcggatacgagatgatcgaccaggaagaaaaagcggattttgtcatttacaatacctgtactgtgcgggaaaacgcgaatcagcgagtgtatggccgtttgggacagctcaatcgtgtgaagcggaagaatacacatatgcttattggactttgcggctgtatgatgcaagagccgcatgttgtagaaaagttgaaaaaaagttatcgatttgtggatctgattttcggaacccataatatttataagtttgccgaggtgcttgccacccgttttgagtccggacggatggtgattgatatctggaaggatacggatcggattgtggaggatcttccgagtgatcggaaatattcgttcaaatccggtgttaatatcatgtttggctgcaataacttttgtagttattgcattgttccgtatgtccggggacgggagcgaagccggaacccgaaagatatcatccgggaggtcgagcgtctcgtgtcagacggtgtcaaagaagtgatgcttcttggacaaaatgtgaattcttacgggaaaactctggaagatccgatgaccttcgcagagcttttgcgtgaaatagaaaaggtcgatggcctggagagacttcgttttatgacgtctcaccccaaggatctttcggatgatctcatcgctgtgatgaaagattcgtccaagatctgccaccacctgcatcttccggtacagtccggaagtacccggatcttgaaaaagatgaaccgcagatatacgaaagagcagtatctcgaactggtggaaaaaatccgtaaagctgtgccggatatttcccttacgacagatattattgttggatttcctcaggagacggaggaggatttccaggagacgctggatgtggtgcggaaagtacgcttcgacagtgcgtttacgtttatctattctaaacggacaggtacgccggcttccgtgatggaaggtcaggtgccgcaggaagtggtcaaagaccgttttgaccgtctgttaaaggaagtacaggccattgcggcaaaagaatgtgccagatttgagagtacagtccgtaccgctcttgtggaggaagtaaacgatcaggatccgtctcttgtgaccggaaggctggacaataatctgctggtacattttccaggtacgaaggaaatgattggagcgttggttccggtgaggcttctgacttgtaaaggattttattatatcggagaagcagtggaaaaataaaccgggcacaccggatgcataatgacagaaataacgtccacactatgtatggaaatgtacaaaagtgaggacgtttttctatgaaaaaaatgagtgaatacttatttctttgggcagtcggcggctgcctttactatacatttgagatcgtattccgggggttttcccactggacgatgtttgtccttgggggattgtgtctggtgttttgcactgcccagggcagggcaggtaaatggcgggatcccctgggtattcagattatacgatgtatgatatttgttacttcctgtgaattcattaccggaattattgtaaacaaatggctgaatctgaatgtctgggattacagcaatgttccgtttcagctctttggacagatttgtctgcctttcatggctttgttcggatttctctgtacgatcggtatttatttgggtggatatctgctgcatcttctttatggagaagagaaaccgcggatcccgatttggtaatgagcaaggaaaagaaatctaaattttcctttttttgcccggaaaatagtgatataatgtaatatcagggtgaagcgccctaaataccaaaacaggaagtaaaaaagataaaatagaaaaagcagctaaagaaaaggagaatcaaagtggcagaattaacaccgatgatgcagcaatatatggaaacaaagaaagagtataaggactgcattttattttatcgccttggggatttttatgaaatgttttttgatgatgcactgaccgcttccaaagaactggagattactctgaccggaaaaaattgtggccttgaggaacgtgcgccgatgtgtggcgtgccgtaccatgcggtggacagctatctgtccagattggtggagaaaggatacaaggttgcgatttgtgagcaggtggaagacccgaaacaggcaaaggggattgtcaagcgggaagtgatccggattgtgacgccagggacgaatatcgattctatgacgatggatgagacgaaaaaccagtacatcatgtcaatcgtctttgatgcgggacggtatggcgtctcgattgcggacgtttcaaccggagattattttgtaactgagacggacagtgccacaaagctgttcgatgagatttataaatttgcgccttctgagattatctgtaatgaggcgctctatgtgagcggtatccagttggaggatctgaaaaaccggatgcaggttgccatctctgctctggacgcatggtattttgatgaggatctttgtaagaaggctctgagagaacattttcaagtatcatcgcttgagagtcttggcgtggcagactatgaatgtggagttatcgcttccggcgccctgcttcagtatctgattgagacacagaagacgtccctggcccatctgacgaagcttacgacttactcgacagggaaatatatggtgctggacagttccacgaggcggaatctggagctttgtgagactcttcgggaaaagcagaagagaggttcgcttctttgggtgcttgataagaccagaacagctatgggggccagactgttgcgtaagtatgtagagcagccactgattgacaaggaagaaattacgaaacgtttggatgcggttgaagagcttttaaaggagtcgatttccagagaggaaatccgggagtatctctcctccgtctacgatctggagcgtctggtaggaaagatctcctatcagtcggccaacccaagggatttgacagcttttaaggcatctcttgccatgctgccccatatccgctgtatcatgggggatatgaagagtccccttctgaaaaatctgtacaatgagattgatccgctggaagatctctgcgatctggtggaacgtgcgattgttgaggaacctccgtttgccatgaaagaaggagggatcatccgggacggttaccatgaggaggtagaccggctgagaaaggcaaagacggatggaaagacctggcttgccgaactggagcagaaagaacgggaaaagaccggaatcaagaatcttcggatcaagtacaataaggtattcgggtattatctggaggtcaccaattcctttaaaaatatggttccggattactataccagaaagcagacgctgacaaacgcagagcggtatattattccggagttaaaggatctggaagatctgattctgggtgcggaggacaaactctatgccctggaatatgagctctactgtgatgtgaggaaccggattgcggatgagatcgtgcggatccagacgacggcaaaagcagtcgccgcggtggatgcctttgcttctcttgcattggtggcggagcgaaatcattatgtccgtccgaagattaacgaaaagggtacgatcgatatcaaggacggacgtcacccggtcgtggagatgatgattcccaaccacatgtttattgccaatgatacatatcttgatgacaggaaaaaccgggtatccatcatcaccggaccgaatatggcgggaaagtctacctatatgcggcagacggcgctgatcgtgctgatggcacagatcggttcctttgtgcctgcatcccaggcaaatatcggtctggtggaccggatctttacgagggtaggtgcctccgatgacctggcctcaggtcaaagtacatttatggtagagatgaccgaggtggcgaacattctcagaaacgctacgagcaaaagtcttctggttctggatgagatcggccgggggacgagtacctttgacgggctttctattgcatgggcagtagtggaacatatcagcaacgcaagacttctgggagcaaaaacattgtttgcgacccattaccatgagctcacggagttggaaggaaagattgacagtgtcaataactattgcattgctgtcaaggaaaagggagatgatattgtctttctccgcaagatcgtaaagggcggagcggacagaagctatggaattcaggtggcgaaacttgccggagttcctgagacggtcattactcgtgccagggaaatttccgaggagctttctgacgcggatattactacaagggtgcgtcagatgagcgtacaagggcaggagacgaaaggaaaagagaaatctcaaaagcttgatgtggtggatatggcgcagatctctctgtttgatacagcgtcggatcatgatgtcatcgaggagcttaagtcgatggatatcagccgcatgacgccaatggatgcaatgaacacattgtatcagcttcagaataagctgaacaatcgctggtaaggaggagccatgggaaagattcaggttttagatcaggttacgatcgacaagattgccgcgggtgaagtagtggagcgtccggcttccgtggtgaaagagctggtagaaaacgcgattgacgcgaaagccacggcggtcgaagtagagattcaggacggcgggatttctctgattcggattgcagacaacggagggggaatggaacaagaagacgtaagaaatgctttcctacgtcactccacaagtaaaatccgcaaagtggacgacctggcacatatttcttctttagggttccgcggggaagcgctgtccagtattgcggctgtatcccaggtggagatgatcacgaagactgaggagagtgtttgcgggacggcgtaccagatttccggtgggaaagaggtctctctggaggagaccggtgcaagagacgggaccacctttctcgtgcgccagttattttacaatgttcctgcaaggcggaaatttttaaaaacaccgatgacggaagcaagccatgtaagtgacctgatgacacggcttgccttgtctcgcccggacatttccttccagtttattaacaacggacaagaacggatgcatacgtccgggaacgggaaattaaaagatgtgatttaccatgtttatgggcgggagatcaccgccaatctgatcgaagtttcccgggaaaacggggagatccggataaccgggtttatcggcaatccgacggtcacaaggggaaaccgcaattttgagactttttttgttaatggcaggtatattaagagcgggattttgtcaaaagctgttgaagatgcctataaggatttcaccatgcagcacaaatatccgttcatcgtactgcatctggagattctgggagaagaaattgacgtcaatgtccatcctactaagatggaactgcgctttgggcatcagcaggaggtatatcagttcctctatgagacggtatcgggagcgcttcatggacgtgatctgattccaagagtggaagccccggaagcgccaaagccaccggaaatcccaaaagcatccgatacaaccgggacaccgaaaacagcaaatctctctgtacaatccggagctgtcacaccgggggcgccagaggtttcagcaggagtggaaaacgcggttacaacaccagaaaaaagggatctgaattattttatggaacggatgcgggatcgggtaacatcttaccataatcagtttgcttctgcggaggtgaaagagcggggagagatccataaaccgtcattcaatcaggagcggatccgggaagctgtctcctaccgtacccgaacggaacagcaggaaaaattgacggcagaacagcagaaatcagaacagcttaccttgtttgatgagaaacttctggatgaggcgtccgtgccggactacaagatcatcggtcaggtgtttgatacctactggatcgtgcagttccatgacagcatgtatatcattgatcagcatgcggctcacgaaagagtactctatgagcggaccttaaaggggatgaagacaagagattatacgtcccagtatatcagcccaccgatcattttggatctgtctatgcaggaggcggaattgtttcgccgttatctggaccgtttcacgaagatcgggtttgagattgagccgtttggaggagattccttcgcggtacgtgcggtgccggacaatttgttcagtgtggcgaaaaaagagctgttactggaaatgattgacagtctgtccgatgagatcagcacgaatatgacaccggagattctggatgagaagatcgcttccatgtcttgtaaggcggcggtcaaagggaattcaagactgtccagaaaggaagtagaagagctgcttttggagcttttaaaactggataatccgtatcactgtccgcatgggagaccgacgatcattgctatgacaaaacgggaactggaaaagaaatttaagagaatcgtatagaagggtgaagatacatgaaacgaccactggtcatactgacaggtccgacggcggtgggaaagacaaacgcctctattgggcttgcaaagaaaatcggcggagccatcatatcggcggattccatgcaggtttaccggcatatggatatcggctcggccaagatccgtccggaggagatggacggggtgaagcattacctgattgatgtgctggaaccgacagaagagttccatgtcgttcgtttccagaagctcgcaaagcaggccatggaggagatctatgagaatggactgatcccgattgtgaccggagggaccggattttatattcaggcacttttgtatgatattgattttacggaaagcagggaagatccggactaccgacgggagctttccttgttcgcggaccgttacggtgaggaggcgctccatgagaaactccgtgaggtagacgaagaagcggcaaacgagatccatccgaataatcggaaacgggtgatccgggcgctggaattttaccatcttaccgggaaaaagatttcgctgcacaacgaggaagagcgaaaaaaagagtcgccgtatcagtccgcctattttgttctgaacgatgaacggagcaggctgtatgagcggatcgacgccagggtcgatcagatgttggaagacgggcttgtggaggaagtacgtgcgttaaagtccaggggatgcaaccgaaatatgacctccatgaaagggctcggatataaggaaatcctcgcttatctcgatggggagacgacgcttgaagaagctgtgcggatcttaaagcgggatacgagacattttgcaaaacgccagatcacgtggtttaaacgggagagggatgtgatctgggtgcggaaacaggattttaattatcaggaagacagaatcctggcgtttttacttgaaaatctgaagaaaagaggaatcatagaagatgaatcataacatagaggaacgattaaagcagcattacgcggaggcaggcatttcacggaaggtctacgagttcggaatgaagatcgagacggatttaaaggagcgatttgaaaccatcgaccagattgcggagtataatcagctaaaggtcgttcacgctatgcagaaagcccgtgttaatacggagtgctttcagtatgcgtccggttacggatacaatgatttcgggcgggatacgctggagaaggtgtacgcctatatttttcatacggaggatgctttggtgcgtccgcagatcacttgtggaacccacgcccttgctcttgcccttgccgctaatctgcggccaggtgatgagatgatttctgtggccggtaagccgtatgacacattagaagaagtgatcggaatccgtaagtccaaaggttctttaaaagaatacggaatcagttaccgacaggtggatcttcttgcggacggcagctttgactttgagacaatcgaaaagacggtgcgtcctgacacaaagcttgtgaccatccagcgttccaagggctaccagacaagaccgagcttttccgtggagcagatcggagaagtgatccgttttatgaaagagcggttcccggatgtgatttgtatggtggataactgctacggcgagttcgtagagcttcaggagccaagcgacgtaggcgcggatctggttgtcggttccctgattaaaaatccaggaggcgggcttgcgccgatcggcggatatattgcgggaagaaaggatctgattgaaaactgtgcttaccgtctgacttcaccgggactgggcaaggaagtgggagcgtctcttggggtaatgaaagacttttaccaaggacttttcctggctccaacggtcgtcaaaggtgcggttaagggtgcgatttttgcggcgggtatctatgaaaagctgggattttccgtgattccgtccatgaaggaagagcggcatgatatcatccaggcggtcgagttcggaacggctgagggtgtgatccgtttctgccagggaattcaggctgcggccccggtggacagttatgtgacaccggaaccgtgggcgatgccggggtatgacagtgatgttattatggcggcgggtgcttttgttcagggttcatctatcgagctatcggcggatgctccgatcaaaccgccatatgcagtttattttcagggggggcttacatgggagcacgccaaattcggaattctaatgactcttcaaaaattgacagaagcaggtgttgtaaccattgaataaaggagaaagcatgatgaaggttgtggtaatcggaggcggagcttccggcatgatggcagcgattgcggcggcgggagcgggagcccgggttacgattctggagcaaaacggggagcttggaaagaaaattttatcgaccggaaatggaaaatgcaattttaccaatatacggcagatgccaggtgcttaccggggagagcacccggattttgccatggaggtcatcagccgattcccggtgccggagacgatccggttctttctggagatgggactttactccaagaaccgggatgggtatctctatcctcattcggaacaggcgcaggcggtacgggacgtgctggtcatggaattaaagcgtctacaggtaaaagtggaaaccaatgtgtttgcagagaagatcacaaaaggagcacgtttccatataacggcgaaacggtatctccaaagaccggaaaagaaaagtaaaaaacgaacggttcttgtgactgtaggagaagaggaacagacttatgaggcagaccatgtcattctgacggccgggggacttgccggcagagtacaaagggcagatggaaccgggatgcggatggccgggaagttaggacatacgattgttccctgcgttccggcgctggtgcaactgatgtgcgaagaagcgttttacccgaagatttcgggcgtgcgtgccggagcgaagatagagcttgtgtgcggcggagaagtaagagcgctggatcagggagaaatccagttcaccgattacggaatttccgggattccggtttttcagattagtcgttttgcggcaaaagcgctgtcagaaggtaccatagaagtaagggcagagcttgattttatgccggattttacgaaagagcagttgaaaagtttccttttgtcacggattcagatgaggcctgagaaaccggtgagaacatttctgaccggagtatttcatgagaaactggcatatattttgttggaacgagctggcatttcaggaaaatttctggcaaaggatctgacaaaggcagatgttgactgtctggttcatgtgatcaagatcttttccacccggatcacagggacgaaagggtttgatcaggctcaggtcagtgccgggggaattgcgacggacgaagtagattctaagacaatggaatcccgtatcgttccgggactgtttttggcaggtgaggtgctggatatcgatggaatgtgcggcggctataatcttcaatgggcatggtcgagcggctatgtggcaggaaggagtgctgcgggaaaggagcaggcatgattcgaatcgaacagataaaaatgaaaaccagccatacaaaagcagagctgaaaaaaaaggtagggcacattcttggcgtttccggagaggaaatcacaggaatggagattatcaagcgctctatcgatgctcgtaaaaaaccggaaatttattatgtctatacagtggatgtggctctgtcaaagacgaaaagagagtggtcgatcttaaatcgtggaaagaacaaaaacatatcaagggcagaagaaatatcgtacacgttttcagtctgtacggacggaaacatgatggaacagcgtcctgtggtagttggaagcggaccggccggactattttgtgcctatctgcttgccaagtacggataccgtccgattttgatcgagcagggagcgccggcgaaagagcgccgtaaagcggtagagacattctgggagacaggagttcttgatatccgtacaaatgtccagtttggagagggcggtgcggggactttttctgatggaaagctgaatacactggtaaaggatccagacggacgaaaccgggaggtgctgcggattttcgtagaacatggagcgccggaggagattctctacgagagcaaaccacatataggtacagacatactgattgatgtggtacaaaagatccgtaagtccattgagtcttatggtggggaatgtcggttttacacgaagatgacaggcatacagattcaggatcacaacatcgtcggaattgaaatcgagcagcatggaacccactcattacttccgtcacagacagtagttcttgctctgggccacagtgccagggatacgttcgcgatgttaaagaagtccggtgtttttttggaggccaagtcctttgctgtaggcgttcgggtagagcatctgcaagagcagatcaatctgtcccagtatggaacgaaacagcatccggatcttccggcggcagcctataagctgacggcaaaagcaggaaatgggcggggtgtttatactttttgtatgtgtcccggcggttatgtcgtaaacgcatcctcagaagagagacgtctgtgcgtcaatggaatgagttatcatggaagagcagagaaaaatgccaacagtgcggtgattgttacagtaaccccggaagactttatgggggagaataaggatcctctttccgggatcgcctttcaaagagaattggaagagcgggcataccgggccggaaagggaaagattccggtccagtgcttcggtgatttctgtgaagataaggtttcgaccgaatttggggagattcttccccagatgaaaggagcctgcacgtttggcgatgtacgtggaatttttccggaggacattgcaaaggccattcaggagggaatccaagattttgaacataaaattcacggtttttccagaaatgatacggtactttccggggtggaggcgagaacgtcttctccggtgagaatcacgagggacgaatccatgcaaagtctcgggattcgtggactttacccttgtggagaaggagccggatacgcaggaggtattacttcggcggccatggacggcatcaagactgcggaggcgatcgcgaagcaatatcgtccggtggatcatgatgaaagaaacacggtgattttgtaaaagaaaagagagtgcgggaacaagaaagggggatccgtatgaaggcattgacctatatagagcatgataaatttgctatgattgacaaacaaaagccaaccctgcaaaatccgcaggatgcgatcgttcgagtgacaatgagctcgatctgtacaagcgatctgcatatcaagcatggcagtgtaccgcgggctgttccgggaattacggttgggcacgagatggtgggaattgtcgagcagattggagacgaggtgatgtcggtttgtccgggggacagagtgactgtaaatgtggagacattttgtggagggtgttttttctgcaagcatggttatgtcaataattgtacggacccaaatggaggctgggcgcttggatgccggatcgacggcggacaggcagaatatgtccgggtgccgtttgccgaccaagggctgaaccggattccggacagtgtgacggacgaacaggcactctttgtaggggatattctggctaccggcttttgggctgcccgcatctccgagatccagccggaggataccgttctgatcatcggcgcggggcctacagggatctgtacgttgctgtgcgcgatgcttcagaatccgaaagctatcattgtctgcgaaaaagaggaggaaagacgtctgtttcttcggaagcattacccgaaggtgctggcctgtacaccggaagaatgtgaagcatatgttcttgctcattcggaacatggcggggcggatgttgtcatagaagcagccggcacaaaggacacctttgagcttgcctggaagtgtgcccgtcccaatgctattgtgaccgtcgttgctctctatgaggaagcgcagatcctcccgcttccacagatgtatggaaagaatctgacctttaagaccggaggcgtagatggctgtgactgtggtgaaattttatctttgattgaacaaggaaagatcgatacaacgccattgattacacaccggtttcctttgtcggaaatcaatgaagcctatcggatctttgaaaaccggctggacggcgtgatcaaaattgcggttacagcagaataagctggattccattttgcatcatttcgggatcatggagcagcagtcggggggaatggatggaatacccgtatggaggcgccggcaccaaagccgggacagatgatgctctgggcaatgcagagtatcgcacatggggcggattttgtcagtttttttcgatggcgaaccagcgtgatgggttcggaaatcacgataaaaacacctgtagaggatatggacacagtagagaaggtacaagggcagagagcatttctaaaaattcagataagaaattcttgtgctatgaaatcaatgggaacaaaagaaagagacagaacatattggacttccaacaaggccgatatgttctgtctcttttttattcggtggcaaaaatcgaaataaaccgactacttttgtcgtttccatggagtatacgggattcgaacccgtggcctccacaatgcgaatgtggcgcgctcccaactgcgctaataccccatacgaaaattatatcacgaaagaacagaatttcaagtatgtatttagacgaaaaattgtataaagaaatactttttaacttgtacaatacaacgaaaaaatagttcatataaactttatatatatctaatatagactaatataaaaaatatgttaatataaaattaatattttaagtaggaagaaagagcaatatgggaagtgttcaggtaaagaatagcgatttgcaccaaaagttaaaacatgtgtccatttaaaagaataatgattgaaaattatatctgtgataattatcaaagttttaaagatgagggataaagaatgaaatcttttatgaaacattacaaatttgaaagttctattatttttttcgaattactgtttcaaaatttacttctcttaggtagtacgctcattacgatgtacatggcaaagcttgtaatggaaggggatttgcgaggaattttgatttgttctgctgggatcatgattctctatctgatacttcacctcttattttggagttacgatgttcatctcacgaaagtaatcgcaaaaatcaatcaagccatgcgggagaatctgaatcatcagatgttaagtaaatctgttgaacaattaaaaaaaggtgattccggagagtatttatcctggtacattaatgatttaaaagaagcggaagaaaaaggcatccgtaatttttatgatgccatagatgaaatcataaagttagtgttaggcattattgtactaggagcaattaattggcggcttttgctttgcacactgattacaacaggtatggtttatgtattgtcccatcgttttggaaacgatgtgaaacaagagtctgaaaaagtgtctgcaatatgggaaaaatttacgaaagcagtaaaagaacagatagggggagtcagagttcttaaatatttcggataccaagatcgatttcaacgtcagattgaaggagaatcaaaagagctggaaaaacaaagatatatatatgtgaaaacccagggaaaagcaacgctgaaaattagagggattaattccgtggcgagttttgtcaataatatggtgttgttcggaatgtgcgctcttcgtgtgattccagcagaaatattttttggaggaggaaacttaatcaatcaggtaaaaaattctatcctcacactttctgaactgcgggttgccatggatggagccagaccatattttgaaaaaatcaatagaatggcggaggaaacggaaaagaaaaaagaacttccgatgattaacaatgaaattgaattccggaatttgagctttgcctattcggagaagccggtttttgaaaacttgaatctgaaatttaaagtcggtgggaaatatggtatcataggaaaaagcgggagtggaaaaacaacattattaaaaattcttttgggacaattaacttcatacagcggagaattactttttgacggcgtggatgctgctgtgtatgatacagaatcgttttatcgacagatggcatatatagaacaaaatgtatttctatttcatacgacaattcgggaaaatatcactctcggtgcagagtttcagaaggaagaactggaagaggcattacgcaacagcgcactttatgaggatttaaaatcatttcctcaagggcttgatacggatgtgggcgaaaatggagattgtctttcaggaggacaaaaacagagagtggcagtggcacgggcattgattcataagcgaaacattcttgttgtggatgagggaacttcggcgctcgataaaataaacgcaaagaagatagaaacggctctcttaaagtccaaagatgtgactttgctatttgttagtcatcatttggaagaaaaagacatgcagaaatatacaaatgtatactgtctgggagagaaggtggcacaatgaaaaagtatctgttgcactataaaaaagaaaatgccgtattactctttttgatgatttttataaatggaatcgagacgagttttgcatttctgcaaatgtatataggtaagcaggttatagagggagaaattaaaaaagtactgcttgttgtggcttttaattcagctcttgcatattttttctatgtgcttttatatataaggaaaaattatcaaacatatcttatttccaccatgaatacggagcttcgaaatgacattagtaaaaagatacttcatgaatcatttgaaaagaatgtgggaacagatagcggagagtatgtatcctggtatactaatgatgtcagagaagctgaaaaccagggcttccaagttttttacagttatatggatacaggattcagacttttgatgggagctatttctttgctttttattaaatgggaattgttggcattgacattggtcgtgtccggtatttctatgtatgtaagtaaaagattcagtgataaagtggaaaaatatgcagaaaaagtatcactggcaatggaacggtatacggacaaagtaaaagaacagattgcaggaatctgcatcttaaaatcctttggaaatccgcagaaattttataaagaaatcatggaagcgggcaaagcatttgaagaagaaaaatgtgattttgcaaagaacaagggcaaagaaaattataaatcaacagtaattagtatttttggaatcaatgcaataaatattctgacatttgtgctttgtgtactgcgaatcatcgcacctgaaataattttcggaagtttgaatcttacaaatcaagtaggaaatgcattcagccagttgatttcagcaaaattgcaaattgcgggttcaaggccatattttgcaaaagtagattgtgataaaaataccgaagaaaatagaataagcaaaaaacttccggcacttaagaaagaaattgttcttgaaaatttatctttttcttatgggaagaagaaagtatttgaaaatatcaattatacatttgaaaagaatgggaaatatgctcttgtaggaaagagtggaagcggaaaaacaacgctgataaagattatgctcggacagttaggaaattatcaagggaaaatctactatgacggagaagaaatttcttcttttgatgggaacacttattatgaacagatggcatatatcgaacaggatgtgtatctttttgattgctctataagggataatattactcttggaagtgacttcccggaagaaaaaatgcaggaagtattggatatgagtgcattgcagaatgatttgaagacactaccggatgggttggatacgaaagttggagagaacggaaagaacttatccgggggacagaaacagcgggttgccatagcaagggcgctgattcataatagaaccattttattcgtagatgaagggacctctgcgttagataaagaaaacgctgcacttgtagaggaagccttattggcctgcccgacacttacattgattttgattacccatcatttgaaagaagagaatatttctttatatgataagatttacagtctttcttatgagtaattttcagaaaaagaagagtggattttcctgcatacaaagaagacatcgcaaactggcggtgccttttttatttaagaggctgatgttcgacaactggctgcgttttaataagggttttattgacgacacattgacgacaagagtgcctgcaagctctgtaaatacgttgtcgattcttaaggaaaatttaatacggaaaaaggctatacacattttttgaagtgtgttagaataaaagcggtttgtaaaacacaaaagtttggagggtatacagatgaaaggagcaagaagcaaaaacggatggggattactcctgatgcttctggcaggcattgtgttgggcggatttatagggatgctcgcacaggatattcctggacttggatggctttcttacggtcagacgtttggcctgcaacagccggttatactggatcttgggattctggttcttactttgggactgagtgtgaatatttctatcgccagcattgttggcatgattctttctatcattatttatcgcttcttataatctactgaaccgatcattagagtttacaaaagatatgaatcaaacaatgaaagagttactagaagaggaacgtccatatgaaaagtgtggacgttttggtgccaaaagcctgacagatattgagcttctggctgtgcttttaagaagcggcacaaagggcggcaatgtccttgagacggctaaaaagatcctctatccgtccggaagagagggcgggcttacaagactgccatcttactcgcaagacgcgctgatgaagattcccgggattggtaaggtcaaggccattcagattctatgtctctgtgagatggcaagacggatcgcgaaggaaaaggcaaaagaacctctttcttttgacagacctgagacgatcgcatcttactatatggaggatatgcgtcatctcaaacaggaagaactaaaacttctgatgttaaatacaaaatcaaagcttcttggcgagacgcggatttccaaggggacggtcaatatgtccgtcatttctccgagagagctgtttatagaagcattgcagaaagacgcggtgtcgatcattctgctccacaatcatccgagcggagatccagagccgagcagagaagatattcttgtgacaaagaaaattgcgaaggcaggggagctgatcggaattacgttgatggatcacattatcatcggcgatcagtcgtatgtaagtcttgccgaaaaagggtgggtataaagaagagaagggactggaagaaaatgactggaaccatttatggcctggatcctggtacgtatcagctaaagatttatgataaaagagaagaccggatccgtacggtaaagaacgcagtcgcaatccggaaccatacagatatttttgcggtaggcgaccgggcatatgaaatgttggaaaaaacgcccggagatattaccattgcgtttccgatgaaagagggtgtgatatccaggattggagaaatgcagtaccttctggagtgcgtgctgaggacggaagaaggcttctttacaagagggacggagtatgtaattgcggttcccactgatgtgacagagatggaaaaaaaagcattttttgatctgtttatccattcttcagtcagggcgcgtgaagtacggattgtagagcgctgtattgcggacgccattggcgccggaattgatatccgacagacgccgggatcggctatcgtcaatctcggcggtgagacgacagacatcgcgattctttccagaggcggaattgttctgaacagactgttaaagacaggaggcgcattcctggatcagatggttgtcacgatagtgcggagaaatcttgactttgtgattggcaggcccacagccgaggaggtacgcaggaaaaccgatgtgtttggagaggcagtacgtcctcctgttttggcggcagggagagatctgatccggctaaggcctggagtaagagaaattcctagtacgatcgtacgtgaggctctggaggagttcttaaagccctgtatccgaactctcttattgatgcttgagcagacgccgcctgtagtgcttggggcgatcagacggcagggaatctgcttgacaggcgggattgcctgtacgaaaggattgacgggatatatggaggcacagacaggggtaccgttttatacggcagagcagccgcagctctgtgcggctaggggcgtgcgtagcattattgtggacagggattttgaagatctggcgtattccatgaaagacgaaaattataggtggatgagataggatgaagacaagaaatcaaaaaggtttggaaagtaaatactggctgctgattattgtggctgcctgcattttgtgcatggcggcgaccttttttgcgggtgttaagagcggtccggtgcgtgtgattgcggattatacggttgtcccgatgcagaaagggattaatgtgatcgggacgtgggtcaatggtgtggcggacaattttgtcacattgaaaagtgttcagaaggaaaataaaacgttaaaagaacagaacgccaatctgaagatggaaaataaccagcttcagcaaaaggcagtcgagctggagcgtttttatgatttatataagatggatcagaatacctcggattacccgaaagtgggtgcgcgtgtcattgcaaatgacgggagtaattggtttacgtcctttacgatcgacaaaggaagtgcggatggtatccgggaggatatgaatgttttgagtggaaatggtctggttggaattgtcacaaaggtcaacgcacattcctccaccgtacgctctatcatcgacgaggttaatatttcatccatgataatgacgacttttgaccagtgcattgtcagcggggacctcaagctcattaacaatggagtggtgaagtttgagcagcttgcgaataatgaaaatgaagtagcggtcggggagcagatcgtcacatccaatatcagcagtaagtacttacaagggctgctgatcggttatgtcagcgaagtcaatgtggattctaacaatcttacacgatccggctatatcataccggcagtggattttaagaagctgcaggaggtgctcgttattacaacgacgaagcaagatctgattgataatggcaatcagacacagagtgattcatcagaaaaatagaaaggagaggccatatgctggctgtaaagcgcaaagggatcgaagccgtgatggtgattgtgctgtttctgcttgaaacaacagtgtttcattattttgagatcgcgtcggtcaagccgaatcttctgctcattctgactgcatccttcggattcatggaaggaaagagggaaggaatgtatgttggagtgctaagcggttttttgcttgatatctgttttggacagtatatcgggttctatattttattctacacactggttggttatgccaatggattttttcagaagctgtactatgatgagaatattaagctccctctgctgttgatcgggagcagcgagctggcttatgggattctgatctatgtgttccagtttatgttgcagagtgattttcatttcctgtattacctgggacatttgattattccggaaatgctctatacggtaatcctcacgttgattgtatatcagatcattttgagaataaaccggaaacttgtagaggaagaaaaaaggagtgcaagcaggtttgtttaatattttggaacacataaaagagacagtcatcaggcttgttaagtccagaatgtttatcgcaagtgttgtgttttgcgtgttgtttgcgattctggtgcagagggttttctaccttcagatcgtaaagggcgaaagctatttaaacgattataagctccagattcagaagacaaaagaggttcagggtaccagaggacggattctggaccggaacgggactgttctggcagacaatgtccttgcctactcggtgacgattgaggataacggagattacgacacgacggctcagaaaaataaggagctcaacgcaacggttcgcagcgtgatcgacatcattgaaaaaaacggagattccattatcaacagcttcggtatcgtattaaatgacagcggagagtacgagttttcgacagagggtaccgcaagactccggtttatcgccgatatttttgggtatgctacaattgacaagctttctgagaaacagaaaaactatacggcggatgatatcatacattatctctgtacggacaagacttacggctatggaattgatgaggaaaagtatgagaaggcagatgtcttaaagcttgtcaatatccgctatgccatcagcctgaataagtaccggaaatatattgcaacgacaatcgctacgaatgtcagtgatacgacagtagcggagatcatggaaaaccaaggggagctcactggtgtcagtattgaagagagctcgatccgtcagtacaataacagtaaatattttgcgtctatcatcggctatacaggacagatttctcaggaagagtacaatgcgctttctgaaaaggaaaagaagtcctattccctgacggatattgtcgggaaagcaggaattgaaaaaagcatggacagtacgctccaaggagaaaagggcgagaccaggatctatgtcaataacgtcggaaaagtgatcgattccgagaaggtaacggaagcgaaagcaggtaatgacgtttacctttccatcgatgctgatcttcaggttgcggcgtacaatattttggaagagaagctggcggccattctgctgtccaaaatggtcaaccgtctggattatgacagaagcaaggtgacagatgcggacgccattgttattccggttggagacgtctacaatgcctttttcaaaaaccagattattgatacaggacgtttcgcaaagagtaatgccggggcgacggagaagagagtgctggagatctattcccagaatgaggaagctgctatcagttctgttctttcagaactgcagaatgaaaacggaacggcctacaaagatctgtctgacagaatgcaggcttatctggactacgtggtggatacacttctgacggagaattccaagatcctggtaaaggatcggattgatacgaacgatgagatgtacctggcatggaagaacgaagagacgatcagcgtgaaccgctatctttcctatgcgatatccaagaactggatcgatacatccaggcttacagattatctggagggagacgcaagctattccagtgcttccgagatttatcaggcaatcattcagtatgtaggagatatcctttcggacgacggtgcctttgaaaagattatttatgaatacatgatcaaagagggaaagattaccggaagccaggtatgccggattctatttgagcagaatattctgaaatacaatgaaaagcagtacaatcagcttagctccggttctttaaatccatataattttatccggagcaagattgaaagtctggagatcacaccgggagagcttggtctggagccgtgtacaggttctattgtcatcacggatcctaacacggggcaggtgcgtgctatggtatcttatccgggttacgataataatcggctggccaatacgatggattctgattatttcgcgcagttgaattccatgacgtcgagtcctctttataataaggcaacgcaggagaagacagcgcctggatccacatataagccgcttgtctctgtagccggactgacagaaggtgtgattggtacgggaacagcgatttcctgtaccggaatctttgataagatatcaccaatcgcgagatgctggatttatccgggatcccatggaagcctgaatgtagtaagcgcaatccaacattcctgtaacgatttcttctatgaagtgggctacaggctgggaacgtccggaaacgaatacaatgatgcatacgggattgagcgtctccagaaatatgcggaagaattcggactgggggacacgacagggcttgaaatcacagaatccgaaccgaagatttctgacagcgatgtcgtgcggtcctctattggtcaggggaccaacaactacacgacggcaggactttcccgttacattagtgcggtggcaaatgggggagtcgtctacaatctgtcgctatttgaaaaaacaacggatgtcaacggaaagttggtcaaggattacgagccggagatcaggaatcaggtggaaggtgtcgcagactctacgtggacggcagtccacaatggaatgagacgcatggtaacgagtacttccacatttaacggtcttggaaactttgaactgtatggaaagacgggtactgcacagcagagtaagacgcatccgaaccatggcctgtttgtcggattcacgggcggacagggcgaaaaagacattgcattcgcgatccggatcgcgaacggttataattctacgtatccttccgaaatcggacgggatattgtccgctactattacggactggatgaaaaagatgaaatcgtaacaggacacgcagcttctcttggaactgttgtttccggagactgatgctgtacaaaacattacgaaagagagaagacggcaaggcagtagtcgtttcgcgctgccatctgttcatcaagtttggtcttaggaggaaggaacatgggtgaaattattgttattacatcaggaaaaggcggggtcgggaagacgaccaccaccgcgaatatcgggacgggtcttgcaaagctcgggaaaaaggtgcttgtcattgacacggatttgggacttcgaaatctggacgtggtgatgggattggaaaaccgtatcgtttacaatctcgtggatgtgattgaaggaaaatgccggcttaaacaggcggcaatccatgacaagcggtacgaggggctgtatctgctcccgtccgcacagacaaaggataaatcagcaatctcaccggagcagatgaagaagctgacggcagaattgaaggaggattatgattttgttcttctggactgtcccgcagggattgaacagggatttgagaatgcggtagcaggagccgaccgggcagttgtcgtgacgacgcctgaggtctccgcaatccgggatgcggatcggattatcggtcttctcgaatccaagcagatccgaaatctggagcttgtgattaaccgaatccggatcgacatggtaaagaggggggatatgatgtcagtggaagatgtaacggagattctcccaattcatctgctgggcgcgattccggatgacgagcaggtggtcatcgctaccaaccagggagaaccggttgtgggagacgattcgccgtccgggagagcttatatgaacatttgtcggaggctttgcggtgaggaggttcctctcatggatatgaatacaaaagtagggctgttctcacggctcagccatcttttcaaaaagaactaatcaggaggcagagatgggattatttgaaggaatggataaaaaggcatcggtcggaatcgcaaaagaccggcttagaacggttcttgtatccgacaggatagactgtaatccaaacgtatgtgaactgtttcagaaagacctttttttgacggtgtcaaaatacattgacaccactccggaaacctttgatgtttcagtcacccgttcccggatcaccattacactgacaggagaaagactttgaagatactgaatattacaaaatcatatcgtttaaaagattttaaattttcgttgctgatctttgtgcttgccttgacgtcccttgggattatggtcatcggaagtgccaaacattctgtccagggaaagcagatgatcggcttgctgatcgggcttgtggcgttggttatcgtctctttgatcgactatatgtggattctgaatctgcaatgggttttgtacggactgacgatagcaatgcttctggcagtacgctttttcggaaaagatgttaacggggcgaccaggtggattgactttggattcacgacgtttcagccctcagagcttgccaagattcttttagtactgttttttgcaaaatttattatgaatcatcaggatgagatgaagaaaccgcttaccatcattcaggcagtgatcttcctcgctattccgtgtcttttaatatacaagcagccagacctttcgacgaccatttccatagccatggtgttctgcattatgatgtatgtaggaggtttgagctataaattcattggagttgtacttctgattacagtcccgacggttgtcatccttctgagtattatcgttcactcggatgtggacgtgctgcaggggtatcaggaaactcggattctggcatggcttcagccggaaaaatacagcagcgacgaggcttatcagcagaataactccatcatggctatcggttctggtcgtctgactggaaagggactcaacaataacacgacaacttccgtgaagaatggaaactttattctcgaaccacagacagactttatttttgcgattgttggagaagaattggggtttgtgggttgctgtattgtgattggtctgttattattaattgtaatacaatgtctgaggatagggatgagagcaccggacatgggaggcaggattatctgctgcggagttgcttcgcagatcgggattcagagttttatcaacatcagtgttgcaacaggactctttccaaataccggaattccgctgccgtttgtcagctatggaatgtcatcccttgtcagtatgtttatcggtattggactcgtgttaaatgttggactacaacagaaaaaatataaataaggagtgaggaagatgaatataggtctcattgcacatgattcaaaaaagacactgatgcagaacttctgcattgcatacaggggaattctaagtaggaatgagctgtacgcaaccgggacaaccgggcgtctgatcgaggaagtgacaaacttaaacgtacacaaatacctggcagggccgcttgggggaaagcagcagcttggctcacagatcgcacagaacgggattgatgctctgatttttctgagggatccgtccaatccgaagcctcatgagccggatgtgaacgacgtcatccgcctatgtgatacgtataatattccagtggctacaaatcttgcgacagcggaactaatcatcttggcgattgataggggcgatctggactggagagaaatgtacagataagagacaggaaaacttgtaaagaggttgggtatgagtaatcaaagggaagaagaaattctaaggcgcagagagcgaattaagaaaagtaaggaaagacgaagaagaaaccagagcaggaagacgggagagaaaaaaagcagacggaagctgatcgcagccggtgtctcgattgccctgattacggcggcaggcggggccggctatacggtggtcatgggaaacgcccagaagaaagcggaagtatggtcctacgaaaaggagcattatggggaaaatgtcttactttccgagggacttgcggctaccaatctctgtgtttctgcggatgataaaaatgagatcagctatgacggttcgacagacgtccatgctgcgggactttttgatgtggatggggcgagtgttcgatattctaatcggattcacgatcgtctctacccggcaagcacgacaaagatcctcacggcgctgattgcgctggagcggggaaacctttctgatgtcgtgacagtcggaaagaatgcggatgtgtcaagctttccggtggacgcttcactttgcgggcttcacgaaggagaccagttgacactggaaacattgctttatggtttgttattgtcttcgggaaacgatgcggcaacggcgattgcggagtatatctccggatcggaggaagcatttgtggaagagatgaatgaccgtgccaaagaattgatggcggtcaatacgcattttatgaatccacacggacttcacgatgagaatcattatacaacagcctatgatctgtatctgattttccagaactgtattcagaatgaagcgtttttaaagattattgaaacaaagagttatacggcatctatcacccaggcggacggaaatgtccgcacagaggattgggcgccgacgaattattatgcaaaggggattgtaagcgcgccggatggggtcactgtgcttggtggaaagaccggcacaacaggagaagccggatactgcctcattctgttaaacgagaatgtggcggggcatccgtacatctccattgtgatgggtgccggatcgagagctcttctttatgaggatatgaatgcgctcttagacggcgcataggtccaatacggaaaatagcggcgtaccggatgaaaagcctttcaggctgttagttttcggaaaagccacgtatccgtccgaacagactgatcagatagaggccgcaaaggccgaccagtgtgtagatgatacgggataacatggacaggtttccgaaaaggtaggccaccaggtcgaaccggaagactccgacaaggagccagttcaaagcgcctacaatgaccagtgtcagtgcaatgttatcaaaccatttcatatatgataatcctcctttatgaattctttctttagtattgccagaaaaaagaagaatatacaggagaagaaaaggacaggattcatggaacagcagttataccggtcatacagccggtttttaaaagaaaaatatcatgcaaaagtttataagcttccggtcaatcttccgggtacctgtccgaaccgggaggacggtccaggctgtacgttctgttcagaaaaggggaccgggtttgaggcaatggagagggaagtgccggtggcaacgcagcttatccgtacaaaagactatattcagaagcggtatcacgcagaaaaattcattgcctattttcagaattataccaatacctacttcccatttgagacattctgctcttatatccgggaggtggaacaggtaaaagacgttgtggaagtttcgatctctaccaggccggactgtcttggcagccgttacctggcttttttgcatgagtggatgcaaaagaccggaatctgtatcaccattgagctgggacttcagactgcgaattatcatacattattaaaggtgaaccggggacacagccttgcagaatatgtggatgcggtccagcgtatccggcaatatccgtttgatatctgtacccatgtaattttgaatttgccatgggatgacaggactgatgtggcggagacggcaaagctgttgtctgttcttggaagcaatatcgttaagattcattctttgtaccttgcgaagggtacggtttttgccaagcagtatgagcggggagagtttcagatctgcacattggaagaatatatggagcgtctgattttatttctacgtcttctggatccggagattgtggtagagcgttttttcagccggattccgaaagaggatgccgttttctgtaactggggtgcaagctggtggaagctaaaagagctagtagaaaaggaaatgaggagccgtggcgtatgtcagggagacatgtacgcataccgggacggcgcaaaacttgggaagtggaacaagccttagaaaactcactagtcttaaaaagtgaaatcgggaggaagaacatttgggagtcagaaagaagaccacagatatcaggacgtaccagagaaaatggaatatgaatatcggagtcatactgtttgctgtcattttggtctatgtcattgtagaaatcctgctctctgtcactaacagaccaacagcttactacgaggtcggagaaggcgccatcgtaaagaatgtatcctatactggatttgcggtccgctcagaagagacagtggcatcgacaaaagatggttatctgaattttttcaagccggaggagtcgaagcttgcaaagggacagagtgtctgtgcggtatctgacgataagctggatttaagctccaaagaagaggacgccggggagagtcagcttaccgacgatgagaaaagacaattactgtcttctgtccggacatttgtagacaattaccgggagtcctctttttcggaagtctattcggtaaagaataccgtgcaaaatctatatgataagaagacagatcaaaacaaggcagaccgtatgagtgcgacgctgggcgaacaaggagaaggaagctatacgttatgccagagtccaaaggacggaattcttgtttatgagaccgacgggtatgaagacgtgacgatagataaggttacagataagatgtttgataaaagcggctataaaagggcagagagccgtgaaaatcagaaagtcagtgaaggggacgacatttataagctggttaccggcgaggaatggtatcttgtcgtgcggatggatgctgatacggcagaatctcttttaaagcgaagtagcgtgacgatccgtttcctcaaggatgatgaagaaatggttgctggacttcagatagagaagaaagacaaagacacctattatgcatatcttacgctggacagcggacttgtacgctatgctgcggaccggtatcaggatattgaaatccagattgagaatgtcaatggactaaaaattccgaaatcggctgttgtgaaaaagacttgctatcaggttccatccgagtatgttgtcagcaatggtgagacaggagaacagggtgttttaatctatgaggatggaaagaccaggttccaggcggcggaggtgtactatacggatacccagaagaatctggtatgtattgacgccaaggatcttccggcagggactgtgattcagatgcagaattctaacaatacaagatctctgacagataccatccgacagtccggagtatacgaagcaggcagcggctatgctgtttttacttcgattgatattgcggcaaagaatgaagattactatattacaggaaacggtgttgccaatcagatttccaattatgacaggattgtactgaacgcaaaggatgtgaaggatgatgatattctggtatagtcagagaagggtcataggaagaaggctcgaaacagggctgagacaatagtgagaaaggaagaatgacagatggaagaaaactatgaagccgggatggtaacagagaatctggaagaggtggaggagaaaatccaggcggcctgtaacagaagcggaagaaagcgggaagaggtgactctcattgccgtaagtaagacaaagccagtatctatgattaaggaggcgtacggagccggaatccgggtatttggtgagaataaggtacaggaactgaccgaaaaatatgatcagcttccctctgatatccaatggcagatgatcggtcatctgcagaggaataaggtgaaatacatcattgataaggcggaactgattcattccgtggattccctcagattgctggagacgatcgaccgggaagcggccaaaaagcagttaaaggccaaagttcttctggaagtcaatatggcaagggaggacacgaaatttggcctgatgcccgaggaagtaatgaagtttatcgataaagttccggagtatccgcatgtgcttttggaggggttaatgacgatcgcaccgaatacagaagacccggaaacaaatcgacaatttttttgtgcacttcggaaattatctgttgacattgcagacaaaaacattgataatatccatatgggcgtactttctatgggtatgaccaatgattatgaagtagcgattgaagaaggcgccactatggtccgtgtcggtacaggaatctttggtaaaagaaattatgctttagataagaacacaagatgataggagtgtaaaaaatgggtgtattagacaagtttttggatatcatgaaattaagtgatgatgacgatgattatgagaacgatgatttctttgatgaagatgacttagacgattacgaagagaaaccaaaaagaaagctgtttggaagagataaaaagaacgatgaggaagagacattttcccaggaagaggaagaagagtacgagtccagaccatcatcttctcaaggcagcaaggtgacacctatgagacgttccggacgtagaccgcaggcggcgggcatggaagtatgcgtaataaagccgagttctgtggacgacgcgagagagattacagagactctgctgagcggacgtaccgtgattttgaatctggaaggactagatctggagatcgcacagcgaatcattgattttacatccggcgctacatttgccatcgatggcaaccttcagaagatttccagctttatcttcctactgacacctacgaatgtggggatttccggagatcttcaggatcttttgaatacttcatttgacgtgtcttctatcagcaagagatactaagcgtcttgtttgaaagtatggacagagaagaacttttatttcagaaaagactgatcgatctatcccgcactgcatatcagcgcgggattgtagtgttcagcgattttctgaatttgaacgaattaaacattctgcatacgttgccgaaagaagagctgtactccggctacgggacattcggcggctatgctgcatcagagcgtcagatggttgcctttctacctgatgctctttgttatgagtttttgtatcctttttcggttctgcgtatccggccgttgaacaaaaagttttccgaggatctgactcacagagactacctgggagcgattttaaatctcggaattgagcgatgtaagatcggggatatcctccttgtaaatacctgtgaagcagttgtatttgtatcagatcatatgtcagattttttagctcaaaatctgacgcggatccgacataccccggttgtggcatctatagaggagctgcaggagttccagtatgaaccatcttttgaagagatccggggcacagtagcttccgtgagactcgacactcttctggcattagctttttcctcttcgagaagcaggctttccgggttgatcgaaggaaagaaggtgttcgtaaacggaagaatgattgtaagtaacggatatcggcttaaggaaggagatatcatttctgtacggggaatggggaaattctgttatgatggagttctttctgagacgcggaaaggacgctacagtgtagtagtccggaaatatagttagggagagcgcaggagtgagatatgaagaaagatcataaagcgaaacattatgttttggcagtcgtgttgatagttgtagcggtattgttagatcaatatacaaaatatttggctgttaccaatttaaaagataagcctgcttttgttttgtgggacaaagtatttgaacttacctacttggaaaacagaggggcggcgttcgggcttctgcagaacaggcagctcttttttatatgtatcgctgttgtgatttttgtatttattctgtactgctatatacggattccaaagactgggaagtatctgccgctcagactctgcggcatctttatcgtggcgggagccgccggaaatctcattgatcggattcggttcggatatgtggtggattttttctacttccgtctgattgattttccggtttttaatgtggcggatatttatgtgaccgtatcctttgcggttcttctccttttggttttctttcagtataaggaggaggatctggagttttttggaaaaaagaaaggaaccagtgcagatggagaataaagtattacagacgggggaatttgtcggtgaacggatcgacagattcctttcctgcaaattggaagagttttcccgttcttatattcagaggctgatgaaagaaggacacgtaaaagtgggagaaaaggccgtaaaggccaactataaactttgtaaaggggacgagatctcgattgagattccggatgccagcgagccggacatccttccggaaccgatccctctgaatatcctctatgaagattctgatatcctgattgtcaataagcccaaaggtatggttgttcatccggctgcagggcattacagcgggacattggtgaatgctttaatgtaccattgcaaggacagtctttccggcatcaacggcgtactgcggccgggaatcgtccacaggattgatatggacaccaccggatctcttcttgtctgcaaacatgatgaggcccaccggattttggcggagcagttaaaacagcacacgatccgcagagaataccatgcgattgtgtatggaaatctaaaagaagattcagggacgattgatgcgccgattgggagacacctgacggatcggaagaagatgagcatcaattataagaatggaaagcctgccgtaacccactaccaggttctggagcggtttgggaaattcacatatatctgctgccgcctggagacaggaaggactcatcagattcgtgtgcatatggcgtcccttcaccatccacttttgggggatgaggtgtacggcccatcccggaaaccagtgtttaaggggcttcaggggcaggttctgcacgcaaaaatccttgggattcaccatcctgtcactggagagtatatggagtttgacgctccgctgccagagtattttgttgatatcttgcaaaaattaaggaaaaatatataatttttttggtaaagttctatacatttcgcctaaattgatttataatagttctattgatagcgtgacagcgtacggttaaaggagcgtgatgtatatgacaaaaacaaataccattattacgatcggacgagaattcggaagcggtgggcacgagatcggggcgcatcttgccgagaagctggagattccattatatgacaaagagatgctggaccgtgcatccaaggacagcgggattgccgaagagattttaaaggctcacgatgagaagccgacgagcagtttcctatactcccttgtgatggacacatattccctcggatataagaccggaagttactcggatatgccaattaatcataagatttttctggcacaatttgaggcgattaagaagatagcggatgaggggccttgtattttaattggacggtgtgcagactatgccttggagaattacagtaatgttttatccgtatttattcatgcagatacgacaaagcgtgcgaaacgcatcagccggatgtatgatatgacggaatccaaggcgcgtgagatgattttaagaacggacaagaagcgcggcagttactataactattacacaaataaaaagtggtctgccgtacagagttacgacgtctgtctggacagtggaaagcttggcatcgatggatgtgtagaaacgattattgaaattataaaggtcaaagagaggatgaaaaaagcagttctttaggaactgctttttacttcttcccgggtaagccgtaccggccaaccctcgattcgtccgtttaatatagcggtgaacatccgctgttttgcacccggatgatcgagctccagttggtgaatgagctccttggcgtattgccgcttcgtaagtccgtctactggacaccggcttttttccaccggaagatcgtatttgcgctggaatccgatgacgtcggcctcatttacaaacatcattggccgtatcacggtcagacccatccggtccagataggactttggggagaaagaatggaaacgtccctcaaagatcagggaaagaatcatcgtttccacgatgtcatccttgtggtgggcgtaagccaccttattgtacccaagctttttgactgcttcattgagggcgccttttcgcatcttggcacacagagagcatggattgctttccttacgctcttcaaaaagaatatgcgcaatatcagtttttatcacatgatatggcaccccaagctcccggcagagagcatcgatcttttctgtgtggaatttttcatatccaaggtctacggttacggcggtcagttcaaacggctttggataaaaccggcgcagtccggaaagagcatagagcaatgtgagactgtcctttcctccggagatgccgacagcgatcttatcaccggtttcgatcatctggtattcatccaccgctttccgtgtaaaactgagcagttgctgtaatttcatgtcaattcctcatttcccaaatttcatcatatggtaacaatatatcctatttattttgcgaatacaagttctttcttgcagaatcgggaaaaagacggtaagatagagacgaacaaaaaaggagtgatcacgatgaaatttgtaattcaacgagtgctggaaagcgcggtaaaagtagatggcgagaccatcggagaaatcggaaaaggtcttgtggttctgatcggagttggaagagaagatacaaaagagatcgcggacaagatggtaaaaaaactggtcgggatgcggattttcgaagatgaaaacggcaagacgaatctttctctggcagatgtcgatgggagcctgcttttgatttcccagttcacactgtatgccaactgtaaaaagggaaatcgtccaagctttattgaggcaggagacccgaaagaggcaaggaggctttacgagtatatcattgacgcctgtaagtcccacattccagtggtggaaaggggagaattcggcgctgatatgaaagtttcccttatcaatgacggaccgtttacgattgttttggactcccaggatctatagaaagatcataagagtcagagaggtcgggaaagatgaaagatttttctgcatgccacataccgttcttcaaaggaggaataaaagtcttctttctgataaggagtcaggaaaaagttttgcagtacatacatggatacctgcttttgataggcggtatcttccatgcggtcattatgggactgtaaatcagccagaagataatgccagcggcaaataaagtcctcgtaacgcggcagatccggaatttggagccactttcggatccggatcttggagcggttccgcttcttacattcctttgtctggatgaagtaggagaaagaaccgttctcatatatccgaccgagaggaaaaagacggcagaaaccaggccggaacccatgaatccggcagcgtccgtcctctgataggaaagaacaggcatcctttcctttggtcatgttgagatggggcagaatgatcccgtccacaacggacagtccgacggcctggtcaagcagtgcctcaggggcgaggcttaagccctggcaaagctgataaaaatcatagggatcgaggatgatggagtctcccataccctgacaacaatccgagcagccgtggcagcctccgcagtcggcgcgaaccagatcattggccgtgtagagatttccatcggagatttcattcaaatcgatatttcgcagcatacagcgcctccttgtttgttttataaggactattgtatacggcacatagggggcctgtcaaacgagaatggaggatacatgaagaaatttaagaaaaaagaactgttatctgtaccaaactgcatgggatatttccggattttgctgattccggtcttttgcgttgtttacctgcgggctgatacaccgggtgaaaaatatctggctgcggcgattcttctgatatctaccgtcacggattttctcgatggaaagattgccagacattttcatatgattacggagttcggaaagtttttggatccggtggcggataagctgactcacgcggctgtggcgctctgtctggcatttcactacccattaatgcgttggctcatctttcttatggtaattaaggagggatttatggctgtgatgggagcatggaatctaaagcatgggcagaagctaaatggagccaaatggtttggcaaagtttgtactgcaactttgtttctgctgctccttgtattggtagttttcccatggattcctcgaaagacggcggatttttttattctggcggagatggtcatcatgtttctgacgctgattctttatattccggaatttcagaaattacataagaaatgggaaaggcggcctctataaagagaggtcgccttttgcgcgtgcccgcctggaacggatggaacggatgaccgggacaagaaagatcgcgacaatccctccggcaaatccgttgttatatagattcatactgtcgtagagaatcccgacattgagagccacagaggactggagatagcctgccagaagtccagccagcacgccgaactctccggcaaccggtgctaatgttgtggagaagagaagtgccagcagcgcaccgggatcagtgatagaccagtcctttgtcgtacttgcaaggatcactccaaacataataggagcgatattaaaaaggtgctttccggtagaggaaaagcctacgatcgtaaagattccgccaatagtcggtccgttaagatctccgcctacaatcagaacgagcagcatggcaaagattccgttaatccccatattcagtagaacagaagctttgccttcctgctttaagtaatctgttccggagattcccgtacattttaagatcctcttataagaggtgaatacggtttctttacccagtataatagcagccagaatcatcacagcaaagagccctcccagaatcagggcgaactcaagattgtttccggtgtgccagatcagacgggattttgtttccaccccgaaagatttaaacagggagatcaccacagtggcgatgacaccggaggaaaatcctacattgtacagggaatagccctgatgagcaaaatgtacatgggtggataatggaggcaggacaaatccaatggtgatgccgatgaggaaactaagtggaattcgcacggcaagggataaggattccaactgcataacttgtgtgataatcggggaaagactggtcccgtacaatcctacatagagataactccgaatcgaagtcctgtgataatgggcgtacagatagacgccgaggaggatcgaccagatattgactacattttttccaaagagggaaaatccgaaaattaaacaacaggacgtgagggtatgtccgtcaatttccattcgaagcagataaaggacaaaaagtaagacaagagtaatgagtccggcattgagaaacgcggctccgattcctccgataacgaaatagtcggtaatcagaaaatccggctcccgtataatggaacgaaggccagagagaatctcggaaggcggctgcataaaaagccccacgatcataaaataagcagggaagagcgccagaagaagatagctctggccaagggaaagcttttgtttcatggaacgcatcctttcttttataaagtaatactcatatgattattatatcggaaatccgggaacaggtaaagaaaaaagagacaaaaggactccggtatttccatgttttgggaaagaccgaagtcctttatcattccgtaatagcgtttaggactttcagaaaatctataaaaaatgacttttacaaaatcagaatacagatggttcagcaaagggggtcaggagccaaaataggaatccagtaccgcggcatccttctttacaacgtaggtgctgccgcctttatcctccacactttctaccatacttgtcagcagcacaggttttgaggcggaaggatcggtcgtaaagacgctgaaccatccgatctcctgaccggtggtaccttgttctgatttcagctccgccgtgccggtcttacctgcaagttccatatcggtgcggtgggccgcatagccggatcctgccggattgttgacaacagctttcaggtcttccgtaaggagtgaggaatgttctttggagatggcctgattgatccagacttcggcggaaggatcgtccttgtagatcagatacggtgtgatcatggagccgctgttagaaaaagcagtgtacatcaccgccaggtgaagcggatttgcaagcacctgtccctgtccatagccgctgtccgcaagctggatttcctctgtgatggaaccgtcattatcatactgggactgggacattttgatctcaaacggtacgacttgattgaaaccaaaacgatccagaccgtctgtaaacctgtctgctccaagttcgagggctgcctttgcaaagaagatattgtctgagtagatcaacgcgttttgaagggttcccggtttgtagtcctggagtgtcgtcacataataatcgccccaactggagtctttctgccagctcgtaccgttatagccgtaatctttttcaggatccagggtaccctcggcaagtccgatggcggcggtaaaaggctttaaggtggaaccaggggcaaaagtctggcggaaccggttgtagagtggctgggcttcatcgttatttaactgatcccattcctgtgtggtcaggccgagaataaaccggttcgtatcgtaagatggcgtactgacaagggcaagcacttccccggtgtacggattcatggctacagaacagccctcgtctttctgaaactgctcgtagagtgactgctggagtgtaatatcgatagtcaggcggagcgtctccccgtcagtcttgttctgataagccagaacggatttttgttgtccgtcttcatcctcgatgagaatggtatatccattttgtccacgaagttgtttctcatatagggcttccagcccgctttttccaatcacgctgtcagaagtatatcctgcatccggatgtttttccaggtcttctgccgtgattccggagacatatccgaccagatgtgccgtggcgctgccatatggatagcttcgtacctctaccgtggagagtttaatccccggaatagcaagcagttgattctgcagcttttcatctgcagcggaaatggtagcaagcgggacaaaggcatcatctgtcacccaatctttggaaagctcggattggatgtcctctgtgcttagaccaaggagagaagacaatgtctgcagatccacggaagaatcctcattcatctttcccggaaccaaccctactgagtaggcagagccgcttccggccagcacattctggtttctgtcaaggatctgcccgcgtttggcctcatctgtatagatccgaaccttatctgtagcggtcagttccggaaaaatcatactgtcgtcccagacaaggatcgtgcccttgttgtcatcttttttcactttcgttgtattgtcataggtgatttctcctgccagggtagtcagtgtcacagtgtaagagagttgatttttctcttcggatgtgatcttgacctttacgtttgagcatccgattccttcgtagatattctgatttctggcaatgaaatccttctttgacacttttccactgtccacaagctcaaacattttctcataatctccggactcgatggaagacaggtaagttttcaggatttcggaaggcttctccttctcatttctcatatgcagaaagaacaacacacatgctccgatgatagccagaactacaaggatcaggatcaatggaagaaggaccgtgcgttttctcctggaagagcgtcttcttttttgaatcataacagattttcctcctctatttctaccgtgatatatcttgtccttattatatcgaatttgcagagctattttaagctatttaagtaaaaaataagaaaaatcaaaaaacatacttttttcaaattttcatcacagctttaccataatcctgctttatagtaggaaacgtaaaaaggaaacatggataaaagaaggaagtgtatcaatatgaaaaacagcttatttcatttccataaagaaacgaaggagacaacagacaatatgcagaatcaggattataaagaatatgaacattctgacggatatcagaattacggagcatctcaaaatgatggagactatcaaagctatgggcaggaatcggcagagtcgtatcaggaaagtttgaatggcatgccgccgaagaaaacaacacccaaaaagagaaaaagtgtccgcaaggtagctgcggttacagggcttgccctgctgttcggcggtatcgcaggggcctccttttatggagtgacctatctgacaggattaaagagtccgtcctccggccagattgccaaggccgatatagcgacgcttcagcagacatcctccaaatcgacggatacagacctgaccaaactggtcaaagcaagtatgccgtttgttgtatccattcagaatctgtccgtggaggaagtacagaacttttttggcgggacatcccagcaggaatctacaagcgtagggaccggtattattatcggagagaatgacaaagaacttctaatcgtgacgaatgcccatgtagttgccaatgcagacagtctgactgtcacatttaatgatgagacaagcgtggaggccaacatcaagggcgcggattcggataaggatttggctgttgtagctgttccgcttgacagtattgagagcagtaccaaatctgccatcaaaacggccacgcttggtgattctgatgccttacaggtaggagaagaagttgtggcaatcggaaatgcacttggatacgggcagtccgtaacgaacggtattgtcagcgccaaagaccgggaaatcagcggatataacggaacactgattcagaccaatgcggcgattaatccaggtaatagcggaggagctcttctgaatacaaagggcgaggttatcggtatcaactgtgcaaagatcaatgattcctccgtagaggggatgggatacgctattccagtttctgaagtctcagatatcataaagaatctgatgaaccaggagacaaagacaaaagtcagtgaggaagaacgtggaagcctcggaatccaggtgcgggatatcgatgaggaaacggcaaagcgttatggaatgccgcagggagtatttgtttctgatacgacgcaggaggacaccgattctgatctgcagaggggcatgattatcacagcaatcaatggaacgagtgtagcaggaacgagcgatctgcaaaatgaactgagctattaccgggcagggcaggatgtcaaactgacagttcagactgcggataagaacggagaatacacaaaaaaggagattaccgtgactttggtgaaagcccagacctccaatcagtagggagtcggcataccacttgattttttcggacggaaaccatataatatggattgtacatcttgacaggagtgaaacgatgaacaaaaaccggaatgaacaggataacaggtggtatgaaattaccctgaaagatcaaagcagcaggattgtgaaagggcagcagtccataccagccataaagcgaaaatataaagggaagatccgctctatccggcggatcaccttacagggattacgaaacagaccaaaggagaagcttggcgaatacattgcttttttggatctggaatataatacaggagatcaaaatgcatacccgacggaaatcatttccgtcgggctattgatcgttgagaggaaaagtctgacggaaaaggagtcgtactactcccttgtccgtccgaaaatcaatactgtgctcaatccatattgccaggagcttaccggattgaagcaggtagaagtggatcatgcgccggatttcggaactgtgttcggagaagtgatgaagctgtaccgcaggtggaatatccggcagacgtttgtctttggaaatgcggataaaccggtgtttcttgacaatctgcggctttaccagggtggagatgaactggaacggatcggagagagtatgcgcgatctttctcagtctttgttttttactctttttgaaaaagaaggtagcctgtctctggaaaaaacaagcaggatactggacgtgtctgtggacggagagattcaccatgcgcttaatgacgcaaggctattgttcctctgttaccgggcagtcgtgaaaggagagattccaagcgacagactctccatggcaagagatgagcttctgatccgagaagcctaccatagaggaaggagatttgaggagcctaaatccgggatgtcacaggagaaaaaggaggaggcccttcttctgatcgatgagatgctccggtcagtaaagacagaatcattgaaagagaagggaaaacttctggctctttgtgatgatattctcctggtgacaggggaacggccgcggtttcagaaagaatattttcactggatctaaaaattgcagaaaaaggagaacatcatatgcttcagatcaaacaaatacgaaaggaataccggaccggaaagctgatccagaaggcgcttgacaatgtcagcctgaatctcagggacaatgaatttgtggcgattctgggtccgagcggttcgggtaagacgacgcttttaaatattgtgggaggactcgaccgttatgacagtggtgatctgattattaacgggatttcgacaaagcagtacaaagaccgggactgggattcttaccggaatcatacgatcggatttgtctttcagagttataatctgatccctcatcagacgatccttgccaatgtagagcttgcccttacgatttccggtgtgggaaagacagacaggaaaaagagggcaagaaaggctttggaggaagtgggacttggcgaacagatccataagaagccaaaccagctttccggaggacagatgcagcgtgtggcgattgccagggcgctggtgaatgatccggacattctgctggcagatgaaccgacaggagcactggacagcgagacgagtgttcaggtcatggagcttttaagggaagtagcccaagaccggctggtcgtgatggtgacccataatccggagctggcagaagaatatgccacccggattgtcaacctgaaagacggacgcatcctatcggatacagatccatatgaggtgaaagaatctgagatccagatgccaaaacacaaaagcatggggaaatcatccatgtctttcttgacggcgttgtctcttagttttaacaatttaaaaacgaaaaaagcgaggacacttctgacttcctttgcgggatctatcggaattattggaattgccctcatactggctctttcgaccggagtaaaccagtatattcagtcggtggaggaagacactctttccgagtacccattggagattcagagcactggatttgatatgacgtccatgctcggaggaggtgagagcggcaccgctaaggaagaagaggcaggcgatgtagacgtgattcagatggtgagtaatatgttttccacgatggacacgaatgacctggagtctctgaaagcatacctggatagcaatgaaagtgaattggatgattataccaatgcggtcgagtattcttatactgtcgcgccgcagatttaccgggaagatgacggggaaatccgacaggtcaatccggaccggtcctttgactccttggggtttggatcagcatccggttctaatacaatgatgtcctccatgatgagtacagatatgttctatgagatgccggaaaacacgtctctttacgaaggacagtacgacgtcaaagcagggcgctggccgaaaaatgagcatgaatgtgtcgttgttcttatgtccaacggcagtgtgagtgattttcttctctacaccctgggtcttagagatccggtggaactggacgagatgatccggcagtttatcaatgaagagaatatcacaaccccggagaatatgggaagctactcttatgaagatttcctgggcatcaaatttaaactggtcaacagtgcggattactatgtatacgacagtcagtatcaagtatggactgataaatccgacaatgaatcctatatgaaagagattgtgaaacatggagagaatatcgaggtagttggagtcgtgcagccatctgaggatgccaatgcggtggcactgactaccgggatcggatatccggccgctttgacaaagcatgtcgtagaagaagctaaaaacagtgaaatcgtaaaggaacagcttgccaatccaagtgtcaacgtctttaccggagaagcgttcggtgagagcaaagatgagaacggctttgattccaattctttgttttctgtagatacggatgccttggggaaagcatttcagataaatgatgacgctttctccggcgatttgtttgggaaggtggatctttccgggcttttccaggcagacggaaataacgtggatctttccaagatggtggatctttccggaatatcgatcgatctgccggacgcaggtaatctggatcttggagatttgatgagtgggcttaagctgactgtctcagcggaggggatgacgaagtttgcaggggatctgcttttgggataccaggattatgcgaaagagcatccggaggcagattactccggactgcagtcggattttactggatatttaaagagcgacgccgcccaggagattctgaaatcaagtattcgggatatcattgaggcgaacggagggctgacagcatcgaaacagcagattcaggaactcttcaaggaaatcctggaagggtatatgaagtacgccatggagcatggttatacagatgctgaccggtttgacgagtatctgatggaatatctccagacaccggaagcggcatccattatcaatcaatggggatccaagatctttgaatctttccgggatattgagatttcagatgggcagataaaggagatggcgcaaaaactggcagcgggataccttacttacgcatccgaacatcatttgccggatctgacaaagatggatgactattttgtagattacttaaatactgaggatgggaaggcggcactttcttctggaattggctctatgatcgatatggagagcctggaatcacaggttggcacagcgctggaaagttatatgaaagaagtgatgggggcatataccggagccatctccaagacattggaaagccaggttacttctgctgttgcacagattgccggacagatgcaaagtggtattcagactgtcatgcagcaggctatgggacagataggaacgaatctgcaaaaagctatgggagatgctatgacgatcgatacagaggcttttgcggacgcattccagatgaatatgagtgaagaggaactctcagagcttatgatgtctatgcagtccacaggagaagcgtcttatgacagtaacctgaggtctcttggttatgtggactttgcagttccttccggaatctctatctatccgaaagattttgagagtaaagaggaagtagtccggattctggatgattataacagccgtatggaggctgaaggaaaagatgaacaggtcatcacgtatacggatatggtggggactctaatgtcttctgtgacggatattatcgatatcatcagctatgttttgatcgcctttgtggcaatttctctggtggtttcctctattatgattggagttatcacgtatatcagcgttcttgagcgaaagaaagagatcggaattcttcgggccatcggagcctccaagagaaatatttctcaggtatttaatgcggagacctttattattgggctttgcgcaggacttcttggaattggtattacccttcttcttctgattccgggtaacgccctgattcattatgtaggggatacgaacgatgtaaacgccgtacttccggtagtgccggcattggttctgatcgctttaagtgtcatactgaccctgcttggcggactcattccggcacggaaagcagcaaagagcgacccggtaacagcgcttcgtacagaataatttgaaaaaggcagcagattatgaggagagaaagaagacgatattacgccgtaatgctcatgctgatatttgtatgcggaattgttctgacggcttgtcagggtgggctcacaggaggagagaaaggacagaatcaggaggtgcagaaggaatttttcgccatggatacttatatgacgttttcgctctatggagaaaaggctggggagactttgaaagatgcggaagcaaagatccgtaaactggaatccgaatggtccgtcacgaatcaaaacagcgagatttatcaagtcaatcacagcaatggaaatccggtcacattaagcgaagataccgctgaggtggtaaggtacgcccttgacatggcaaaggagacgggaggtgcactggatcccacgatctatccggtactgacggcatggggatttacaacggggaagaaccgtgttccaaaagagacggaaatccggacgcttctggagcatgtgggctacgaaaaagtcatactggacgggcagacgctcactcttcccgaagagatggagctggatctgggtgctgtggggaaagggtatgccggcgatctgacagccgatcttgtaaaagagcatggtctggaatcggcattactgaatatcgggggcaacatccaggcagtcggatccaggccggacggagaagactggcggcttgccatccgtagtccctacggagaaggggaggtcggacttttgaaagtgtctgactgtgccgtagtgacctcgggcaattatgaacgatattttaccgcaaaagacggcaccagatatggccacatcatagatcctaagacgggatatccggtggacaatgggctggcttctgtgacaattgttacagaggaaggaaagatgggagatgcgctttctacagctctgtttgtgaaagggctggatggcgctaaagcatactggcagtcccacgatgggtttgagatgattgtgatgacagaagaccagaagctctatgtgacggaaggactggatgagaagtttaccttgtctggtacattcagccagatggaaagacatgtgatccgaagataaacatacaggaaaagatattgatacgaaaacgtaccgttattgatctcaaaagagtcaaagaaacggtacgttttttcatgtcatatagttagaaaatcagtgagactgaggtgtaaatcagaccggaagccaccatgatgagaatcgggttggctttgatcttttgcaataaaaagagacagaagaagaaaatcagaaccatcagccagttgatgttgtcaaaccggactggaccttccggccagatcgcggagatcagaatcgagatcccggcggaggcgatcagggagaccacagccggacgaagggaggagaggacactttgaagcgcctccatatcccggtatttcaggtacaatctggcgataatcgtaacgatgatgcaggacggtagaatacaacctgctgtagcagtcaaggctcccggaattccggcaattttaatccccacaaaagtagcggaattgacggcgatcggtcccggcgtcatctgagagatcgtaatcagatccgtgaactctttcatggagagccatccgtgtatggagacaacctgatcctggatcagaggtatagcggcatagccgccgccaaaactgaagaggccgatctggataaaactgagaaacaactgaagataagtcatttgttgggcctcctttctgttccggcaaaagtgcggatcaggccgatgacaatacatacaaggatgatcgccacggcattgatgctcagacaagctgccgcaatcagggaaccaagcataatcagtaccgggatccattttttctcgaacagaattcctgctgccatttcccagacgactgaggcgatgacggctgccacacctacttgcatcccttccagcacaaggctgacaatctgattgtcccgaaatacttcgtagaaaaaggaaatgatcgtgatgacgataaacggtggcaggatggtcgcaatgattgcgacgatggttccgatgataccagccagcttatatccgacgacgatggctccgttgaccgcaatggctccgggcgcggactgggcgatggccaccagatccaacatctcttcctcttcaatccagtgatattcatctacaaattttttcttcattaaagtaacaatgacatacccgcccccaaaggtaaacgcgcttaaataaaaggtcgataaaaacaatttgattaaaacgtttcttttactctccatttgagaatcctccttcctgttctagtatacaccctcttgatctatatgaaaaatagtattattctataaaaaggataataaatttcttatgtatgacgtgggaggaattatgacacttcgacacatgaaaatctttgtggcggtttttgaaaacagcagtatcacaaaggcggcaaaggaactgcatcttgcgcagccttccgtcagtttttctatcaaagagctggaggactattatgggcaacgattttttgagcggatcggcagacgaatctatccgacctcagcagccggagacttttatggttatgcagtccatattgtatctttatttgagacaatggaaaaggaactgaaaaacggagatgagcttgggacgatccggatcggtgccagtattaccattggaacccatatcctgccgactctggtgaaaacgtttcaggaaatattcccggatatacgcatggaagcagtcgtcaaccagtctgccgccatagagcagcatgtcctgcacaatcatattgatatcggcatgatcgagacccagccggtttccgatgcggtctgtgcagttccgtttctggaagatgagcttgtggcgattgttccgaaggaacatccactggcaggggaaaggggcgtcaccttgtcagaaatggccagatatccgtttctgatgcgggaaaagggaagcgccggacgtgagattctggatgcctgctttgacatggagcagatcagtgtccgacctgcctgggagagttccagcactcaggccattgtccagggtgtagcaaagggactgggagtcgcggtgcttcccgatctcctcgtcaggcgggatctggagcaaggagtggtctttcgggcatggcttttacggcccatccacaggaaactgaatctgatttatcacaaaagtaaatatttcagtaagagtatgactacgtttctggagctgtgcgagacatatggaaaaacaaaagaatcagaagaacaaggaggaaacgacagatgaaagatcagacatacattacggttaggactgcatcgccttgggatgcagagcagattcttgccgtgtatgcaccttatgtggaacacacggcaattacctttgaatatgaagtgccggatttggaggaatttcaaaaacggatcggcacgaccttacagcgttatccttatcttgtgtcagagaggggaaaagagattgtaggattcgcctatctctccccttttaagggtcgggctgcctatgactggtcggcggaagtatccatctatgtgaaggactccatgcgaaaatgcggaatcgggagacgtctttatgaggaaatcgaacggattgccagagagcagcatcttctcaaccttaacgcctgcatcggatatccggagaaggaagacgaatatttgacgaaaaacagtgtccagtttcatgctcatatgggctatcaaatggtcggagaatttcataagagcggatataaatttggaagatggtacaatatggtatggatggaaaagatgattggggaacacaaagggaatccggaaccgtttcttccattttcggaattgtcataggcatagccagtctggaaaaagactggctgtatttttctgtttatttaaaaacagatacaaaattgagaaaatccgcataaatacagcgaaagaaaaatagggaaaattacaacgaaattacaacaaatgaaagtacatatgcaatgctgaatagccccctttacaaagtataggctaataagtgcttttcaaatgcagaaaagaaatgacaacgcttataatggcatggtataatgcaggcaaagacaaattggaatttgtaggagatattactgtgaaagaaagtagagaacagccaataaatgacgcgtattgaaagattaagaagccttctttaaggaacgaaatctaatgcgacatttcagacagtaagcgtattctggtatctgttctttttgctggaacggcatgaagtcagcttgtaatggtagaatggagatttatatgagtgaatttacaatcaatgaaatgaaagaaatgcaaaaaatactacaagaaaaatacaaagacaaatgggaaggtatttctgctgaagtggggcaaaacaaattactatggatggttggagaaattggcgaagtaattgatattgtaaaaaagcatagcggattaaaagccagtcaagatgaggatttaagaaaggatttgattgaagaattagcagatgtactgatgtattacaatgatgttttattatgttagaagaattaaaatctgcttatgttaataagtttgaaaagaatatgaagcgttggtaaataaaaatatagttgtggaggtagcaaaaatgaaatttaaaaaccctatgttggtagtaactgatataaataaatcagttgagttttataaaaaggtttttggacttcatgtcattatggattttggggcaaataaaactttaacaggtggcttagccttacagacaagtgaaacatacaaagagtttatcggtgcaagtgatatttcttttggtggtaacaattttgaagtctattttgaagaagatgattttgataaatttgctgataggctgaaagaatatgatattgaatatgtccaccctattatagaacattcatggggacagcgtgtagtccgcttttatgacccagataaacatattatcgaagttggagaaaacatgaagatagtgtgcaagcgtttcttaaatagtggaatgacaccagaacaagttgcagaacgtatggatgtacctatgaaatttataaatgcttgtatgcgataaattgaaagttaggagactaatactatgaaaggatttgaacgcagaaatcaattattttctctttgcggattgaattgcggactatgtcctatgcgtttgggaaattactgtggcggttgtggcaatggtaatcaatcatgcggaattgcaaaatgtagtcttgaacatggaaagattgaatattgctatgagtgcaaacaatatccgtgtgaaaaatatcaacacattgatgattatgattctttcatcacgtataaacggcgaaaagcagatttagaaagagcaaaaaatctaggtattgagcaatacaatcttgaacagcaggaaaaaacacaaattctttcttacttactttctaattataatgacgggcgtaggaagactttcttttgtgtggcagtcaatttattagaactttcagaattgcaagaagcaatgaaacaaatacaatccaatgacgaattggccttactaccatttaaggcacaatgcttgtatgtggtagaggtgtttcagaagattgccgacagaagaaatataaaactgaaacttatcaagaaaaagtgattttcaaatttcagtttgaaattttatatccatacacacaaagcagttagtcttagaattgactgcttttttcgtactcagaaaggagtgattgatttatgcgtatgattttaaacaaaggacactgcatcagagccagcgacaagaactttgtctatcacttttcctttggaacgcttctgttacgacagtttcaagaagcctgttgatactatgcttgcgcctcttttatatacatatgaagaaaaaggggattccttacagtcaggcaaaagatgcatatttacaattctttgaaggggcagtgcgattcgtacaaaatcacattgccctctgaaactttttatataccataggcggaacatcatgaaaatattatcaaatacaaagagaaaacagtatataacagttgacaacagatatatactgttatatactgtttatcataaagaaggaggaacaagatgaatatcataattaacagttcttctatgattccgatctatgaacagattgtagatcaaatcaaaggtatgattctcaacagtacgctgaaggaaaatgacattctgccatcggtgagaagtctttccaaagacctgaaaatcagtgcgctgacggtaaaaaaagcgtatgactgcctggaacaggaaggacttaccgtgacgattcatggaaaaggaactttcgttgcggtggcaaaccgggaattgatgcgagaagagcaacgcaaagaagtggaagccgattttgaactggccattcagaaaggcagacgtttcggaatgcaggagcaggaatttcgggagattttagaactcattttggaggataggctatgataaaagtaaatcaaattgaaaagaactatggaaaattccatctgaattgtacgatggaagtgccggacggttgtgtaaccggactgatcggagaaaacggagcaggaaaaagtacagtatttaaagcgattgagaatctgatttttctggacgggggcagcattgaggtgtttggaaaaccacataccgaacttaatgcaaaggacagagaacagatagcgattgtactctcggatgctaccttttccaatgtctatacgatcaaagatgtggctcgcattatgggcagcgtatatcctgattttgataagaagaagtttatgggtctggtagaacgttttcgattgcctaagaatcaaaaggtgaaggagttctctactggtatgaaggcaaaactaaagctgtttcttgccctttgtcacaaagccagactgctgattctggacgaaccgacagccggaatggatgtggtggcaagagatgaggttctgacacttttgcgggaatatatggaagaggatgagcacaggtcaattctcatcagctctcatatttccggggatttggaaggattctgtgatgaaatttacatgatccatgaaggaaagattatcctccatgaagatacagaccagctactcggaacttatggggttctgaagatgacagaagagcagtaccgaaagattgaccacagtcatctcctaagaaggcgtaaggaaatatacggttacagttgcctgacagatgaaatccattattatgcggagaactatccaggtatcacggtagaaaaaggaagtattgatgaaattattatgctcatggtaaagggggaagcagtatgaaagggatcagaggacttttaatcaaggatttatgcctgatgggggaaatccggaaattacttttaattattctgtttgtcactgccattttcatattcaacggaacgagcagcacgtttctgacagggtatattatgataataattgcctttcttgtgggaatgacgatctcctacgatgagatgaacaatggtttggcgtttttgatgacgctgccggtcacccgcaggcagtatgtggctgagaaatttatctgtggacttctctctctgtttttaggatttgtctatacgatggttgtcgctgtcatccagagcatgattggaaactctgcgccggatctgaaagaaagtattatgactgcagttctctttgccgtgattggagtgattgtgctttctttctccatcgctatagatctgaagtttggagcggagaaaggaagagttatgttgcttttagggtttatggtcatcttctttttattctacatgggtgttgcatttctagaaaggaactttccagaaaaaaaggaagctttccttcagtggtttaatacgatatttgagggatctaagatttatccggtctgtgccgtgatttgtgcagtcgtcctgcttctttcctttttcgcctcctgccggattctggaaaagaaagaattctaaaaagctaagaaactccttctgtcgacagaaggagtttctctgaaatcttcaggatttttccctcagtataacggctttcgatgcgcttctacggcgttcgtcacttaatttggcataatgctttttcgtcgtattcacatcggcgtgtccaagtacgtctgccacaagatagatatccccggtttcccgatagagggcagtaccataagtactacgaagcttatgtggagtgatagtttttaccgagacagcagaacaatatttctttaccattttttccaccgcatctacgctgattctttttttctggccggagaggaagagtgcatcctcgtgaccagagagtggagtgatgccatttctttgcagctccaggtagtcagtgagcgctcgctccacctcctcgccaaaatagacgatcatctcatttcctcctttacggatgattcggataccattgtttttaaaatctacgtcctggatattcagtcccactaactcagatacacgaacacctgttccgagcaggagagtgacaatggcgatatcccggtatttctgtttctgatagtgaaaaagtttcacaccagtcagatcatttccataattttccatatagtcaaggagcgcagccacctcgtcggtatctaactgaatgatcgctttttctttgatttttggcatgtctacgagacgaaccggattagttgtcaaaagttcccgtttacatagataatcgtaaaaactccgaagacatgacattttacgggcaattccgatccgggaattggtctcgatgcgttgatccggcgtccgataggccttgagatattcctcaaactcttcaaaatcaacaggctttaacatagaaaggtccgaaagggaaatctcagaaagaggtttatccgaaagcgcgggattggtttctttgagaaaacggaaaaatactcgcagatcataagcataggataacctggttttatccgatgtggtcgtttccttggcgcgaaaatattcctttacataaggaggaagttcctgaagaaattccctgagctttacagtgttttcaatcttgacctgttcacggtaagaagcaggatttgccataatagatacctccatatttttattagacggttcaggatttcccaacctccggtttctgagagtagtctaacacaaaaatcggggaaaagctatactttttcggataaatctgtatttgtccgctaaattatttccggatagatcaggacgtgcttctttcacaaaaacacgtccgccctaaaattcctgattttgaaggtaaaaattttaagtaaatttgtatcatcttgttagcatttattgttcttcgtgaattccaagtacttcgtctaccggaacggaaaagatgataccgtgtgcttcggactgaagcccgcagacggagctgatttcctgcatgatatgggatttcttttcctttggaacaataatcataacaaaatcctgctcctcttgcatggaaattccgagaaactgtacaactgcctcgctgcctcttcggcgtccccgaatgacggagcctccgttcgctcctgcctttaccgctgtgtcgatgacatcgtcgctgaatccttcccgaaccgccacgataatcatagcatagcatgtttcctgcatcatttgctgaaccttcctttctaaatgtgcttttgcgatcttctcctgctcttcactgaggagactaagcatacttgcctgaatccctgtgatcgggagcgtcagcgcaattccctttccacgcttccggatctcgaacatgttctccaaaaggatgaaaagttcgcctatctccggctttggaacgagtgccgctgtaatcactctcgtactgccctccagtccgcagatatcaagaatttcagtatttgcggtcccttgagcacggaactgatagtaaatgggctgctctgcttcggtaaagagctggtggatctgtttgtccgtaccggtatctgtgatgatcagaagcaggcgaagtgcaaataaatgtggtctcatacttcttcatcctccaattcgataatagtatcttccagagccggttttggtattccggaagattttttcagtttgtgttcgtacacaaggcccatgatctgtatagcgatcaatggtgcaagtgcgactaaagcgacaactccaaaggcatctgtcacgacattgccaccaagcgccgtacaggctcccatcgtcagaggaagaagaaaggtggatgtcataggcccgcttgcaactcctccggagtcaaaggcgattccaacaagaatcggctgcacacgataactcatgccaagagcgagcagatatcctggaatcagaatccagtagatagggattccggtcaggacacggaacatcgcgagtcctactgctcctgctactccaacggagagacaaagattcatctgctcctttgtcaccatgccgtctgtgatgtcttctacctgatggtttaaaatctgtacggcaggctctgcctttacaatataataaccgatcagaagtcctacgggaatcagaagccattgataggagctggaaaccatctgctctcccagcagatttcctactggggcgaatccgatattgacgccgacaagaaatagaaccagtcctgcgatggtatagagaaatccgacacacatccgaagaagctgccttctgtgatattttctggttttaatttgaaacagcatgaaaacggcaagtattggtagcatactgatgagaacctcttctgtgtattgtggaaatgcacggatgaactgatccagcacgtcctttgttgtttccacatctgggattgtgacggatgtatagaccgcatcggttggatggtaaaaaatgccaagaagcagcaccataagaattggtccgatactgctgagggcaatcaatccgaaactgtcgtttgcactgtccttgtcacttcgggatgaggataaaccgattccgagagccataataaacggtacggtcatcggtcctgtcgtcacgcctccggaatcaaaggccacggcgagaaactcactcggtgtggcaagagccacaaggaacagaacaacatacatcagtgtcagaagacgtgacagactgactttgaacaagattctaagtactgcagcaacgaggaaacatccgacccctattgctacagtcagcacaagcacctgattcggaatcgatgctacctgattagcaaggacttgtagatccggctctgatatcgtgatcagaacgcccatcaggaagcatcctcctatgataaaaagaagatttcgctttttcatcagttggcctccgattccctgtcccaactgggtcatggagatatcagcgccaagctgaaagaaacccatcccgaagatcaggaaaagcgcacctgcaaggaagagggtgaacgctcccacttccatcgggatcagtacaatactcaaaagcagcacgatgattgtgatcggcagaacgcttgagagagattctctgactttttctctgagtttttccatccggtcaccttcctttctgatctgtatcaaacaatcctgctgctcttttgtgcggtttcccgccggaaatgaaccagcccagtacgattaagtgcaaccatgatggctggaatcagaatcagttgaacgatgatgcccggaatcgcattgagaaatgcgcctgcaaggaacatttgccaggtgaaagagctgcccgtcactcccaggagaattacttccacaatcccccatatgactcttccggctatcatggaaacaattaatgaacggtacagagcgataatacactgccagcgcgacttttcataaagaaaacctgagaaaaagccgtaagcagcaagctcaaaggacatagcaatacccgtcggaaaaagaaccggcatcccgaacagtgcatatcgcagtaaagggaggacaaatcctacgatggcaccgtaccgccatccacagatcagtccacacagaatcacgggaatatgcattggaagcagcatgtttccgaactgcgggatctgtcccgtcagaaatggaagtacaagacccagtgcgataaacatcgcagaccaggtcagtttctttgttgtttctttcattgttcttctaacctcttttcttgtttcatattttgaagagcctcatactcttctcgcaaaatgctgtatacagccagatccgcaatgccctgattgtttcttccgccctgccgtagtgtcccttcataggtcatatggcatttctccataactttaccggatgccggattgttgatatcatggcaagcttccacacgattgaggtgtacttcctcaaaaaagaaacggataacgccccaaagtgcttctgacatgataccctgattccaccagtctcgacccagacagtaaccgatggagacggtttctgtctcctcgtcgatttttacagcgctgattgtcccgatgggagtgccggggtcatcctttcgagtgatcccccactggtagaaatccggtttcagataggactcaatccactccagaagaatctgtctggtaatatcgggattgatgtgtgcaggccaggtaagaaaccgagtgacatacggatcttttgcccagttttcgtagacggcgtaaacatcgttcatcgtgaaacgacccagataaagtctccctgtttcgattgggcaagtacccttttgttccattccttaatcccccttttctttcttcacataaactgtgataaactatgattattatatcatatttgcatagacgctttttctaaaaattttataaatatcgccttttgtgtttctattgtgtcctttttcagtctaaactggtttgacatcgtccggaaaacatgttattttataatcgttagcactcgacaagcgtgctggctaataaggaggggtttatgattgtaagaccaatgtttaatctggtattacttccagatgttaattattatttcaaaaatgatttcctaaaagactggagtctgtttccgatagaagaaaaagaagagattctatttctcgtattgagggaaaataagccgagggctgaattgcaaccggatgacttctatcctgtcggagtgtctgcgaagatcgagacagtcgaggaggacggcaatcttcggatccatacgctggagcgagtgaatgtatcctgcattgagatccatgacggctatatagaagcaaaagcatgtgttcgcgccggggtgaatgatcttccgcaggaagaggcgtcagaacggttcgggaagcttcagaagatacttttacagtttgttcagcgatatcagtgggggatgtgggcgagaagctatattctccagtggacgactctttcagaggcagtctgtacgctaaccgaatatctcagtctgtctccggatgagaaatatcaaattcttgcggcagattctgaaaaagagcgcttcgatctcatggaacatgcaatcatggaactggtggaagtcactaaggtctctgatgaagcacagacagcgcagaaagataatcaggagctgatctatcgggaggctgccatcaaaaagcagattggctatcttcaacaggagctggatgaaatgcatccggagaatatttcagacgttcagatgtttgaaaagaaaatcgctgagtccgggatgaatgagactgcagaaaaagaagcgatgaaagtacttggcaggatgcgtcaggaaggtcaggacggacacgaatacgggatgctctacgactatttggactttgtcacctctctttcttggaaagagccaaagccctcttccattgatcttgaggaggctgccaggattctcgatgaagatcactatggattgaagaaaatcaaggagcggattatccagcagattgctgtgatggcactgaacaaaaagcagtccggttccattttactctttaccggtgctccgggaacaggcaagacgagtattgggcagagtatcgctaaggcacttggaagagcctacgccagaatcagtctgggaggaattcgggatgaagctgagatacgaggtcacagaagaacctatattggcgccatgccgggacggattatggaaggaattaagcgcagcggtacatcgaatcctgttgttgtccttgatgaggtcgataagcttacccgggattacaatggagatccggcaagcgcccttctggaagtgctggatccggaacagaatcatacttttacagatcattacctgaatgtaccttatgatctgtccaaagtcttctttgtttgcacggcgaatacgacggatacgattccagagccacttctgaaccgaatggaggtcatttcctttaacggctacacagaggtggaaaagcttcagattgcacgaaggcatttgattccgaaggctatggatgctatggggatcccggagaagcagcttgatatcaaggaggaggctctcagaaagatcatcaccgactacacgatggagtctggcgtgcggggactgaaaaagcagatcgatgccttatgcagagcactggcggttcgtctggtgcagcagcctgcaaaacgcctgactgttagagaggctgatcttcatgccctgcttggaaggaaacagctccatcacgatatgcggcttacagaggcagatcccgggattgtgactgggcttgcatggacgagtgcaggcggtgagattctctatatcgagagccgactgatgaaaggtgagggaaaagttacgattacaggacagcttggtgatgtgatgaaagagtctgtccagattgccatcagccttgtcaaaatatactatccggatgagacgaaggtgttggaggatcacgatttacatattcatattccggcaggagcaattccaaaagatggtccctctgcaggcatcactctggttacggctcttgcttctctcgtaaaagaaaaggtggtgccgacagaatatgccatgactggggaagtctcccttcgcggctatgtacttccgattggcggactgacggagaagctgatggcggcacagagagcaggcatcgagaaagtgttgattccagaagagaatgtggaggatctggaggatgtaccagaggaagtaaaggaaaagctcacgatcgttccggtgaaaaggatcagggatgtacttgatcttttgattggaaaatagaaacgatagcagaagctttggcgaaagggccaaagaaaagggaaacaggctgacagcacaattatctgtcagcctgtttttgtgctgagataagaagcatcatagggcgacgcatctcgtctttcatacccggcagatccatcatgtcttccggcggcatcggctcgatcacgtccagaatcgaaaagccgttttggagcaggatctggagataggtagtcagtgtgcgatgatatttggtgacgtgctctcctaaaaaaaccgcatcccgctttccctcataataataatgatccactgggaaatggaggatctctccgtcggctccatagtaccagtcctggttcccataggcggtaaataccggatgctccacggagaacacgaactgtccgtctttgacaagccatgtggagattttctggatcaaagattcatagtcctcgatatagtggagggcgagggagctgaggatgacgtcaaaggatgcatcagcaaagtccagatcctccattgccgccaaatggtaggtaatctgaggatggctgtttttccgaatggccgtacggatcattttttctgagatatccgttccaagtacagtaaccgctccatgctcggcagcataactacagtgccatccataaccgcaccctaaatccagcaccctctttccggcaaaacccggaagcagcttttgaaattctctccattctcccgccccatttaatcctttcttggatcgaagcatttcgccgtacttagcaaagaataccgaattgtcgtaaggattttccttcatgtgcgcctccttctattttctttcctctggattataaccaggcagaagagaaaagtcaattaccaagcgcgtcaggaagggaagatctggtttctgtctaaaaaatagtcgcagaatggaagaatctatgatatactatcaaaccagacagaaaacagacaagtttttcttacttatggagtatagatagatagaaaggagatggttcattcagatgaagcaggaacgtcatttaggaacaatgaaaaagaatcttgggctcgccaccgccacatcaactgttgtgggttgtgtgatcggatcgggagtcttttttaagccacaggcaattttcactgcgacaggagggactccaggacttgggattctggcgtggctaatcgcgggtatgatcagcattgcgggcgcactcaccttttcggaggttgccatactgattccggagaccggaggaatcccgacttatatcaccagaatatatggaccgaagcttggatttctggcaggctggtcacagatggtcctcttctatcctgctatggtctctgctctggctgtagccttcgcacaacaggcggcactgttcataggggagacattcaccgtaccactggcgatcctggtcatcttttttatcgtctttttgaatacgttgggttctaagatcggaggcagtatccagattatctttactgtctgtaagatgatcccgctgatcctgctgattgtttttggattctggaagggaacaggaaactatccggttttctctccaatgatcggagaagggcttaatccggtagttgtgctcggacagcttctcgtggccgtgctttttgcctttgaaggatggactgcggtaggcgctattgcaggcgaattgaagaagccggaacgggatcttccggttgcgattattggtggtgtgtctatcattacggcggtatactgcatcgttaatgtagcctatctccaggtgctcccggcctctgaacttgcttctctttccactccggcctcggcggtggccattgcgctctttggggaagtgggaggacggatcgtatctgtaggaattatgatctccgtattcggtgcctgcaatggattcatcttttccggctcccgtgtaacctactttctggcagataaaggaagtctcccaggaagtgaagcgcttgtcagactgaataagagtcaggtgccgccaaacagtatcttcctggtagggacgattgctgcagtgctgtcactcaccggacagttcaatctacttactgatttggcagttttttcaagctggacattctatacactgacctttatcggggtcatcaaataccggattgagcgaccggacctcaggcgcgcctaccgtgtcccgttctatccgatcgttccgctggtagcgattaccggggggctctacattatcatcaatcagcttttcctctccgggatgcgcgcttggttgatgtcagtgggaagtatcctcttgacattggcgggtttaccgatataccatttggcgcgccggagacgctagatctgggtgaaccgggcgctcttcgagagacaaagagaccatctgcaccgggtatggaatgcagatggtctgtaggtaacatcctatttgtattcggtatcataataggtaataattaatgactgccccggaatcaagccgctcgatttcatatcattaagctttctgatttcgctgatatatacccgatcagatgaaacagaaggctcattgtatttttccgccagactatgaagtgtgtctcctgatttcacttcaatgttcttataatatttgaaataggaaggtgcatccttccggctctctctggcgctggagagaaaccccccaagggtaaatgaggtaatggctacaagcaggagaagaaagaggaatagaaatcttctctttcttgcggcccgtctcctcttctgttcgtatctctttgactgcgcctttctggataatccggtatgaaccgtagctgtatatccctgcatcatctcactcctcctctattaaaagtagaatgtgtttctctttcgaaaagtgtatccggtttctgaaaaagtattcactaatactgcgaacatttgttctttctgaaaccaagtataacgtacaaacatatgtttgtcaattatttttaacaaaaaaagagaaataataggaacaaacgttctgaagagcaggaggacaaaaggaaacagcgaaactatcgtttaacgataaatttttgaaaatggatcattgtttcattggacttctcatgttgaggaccaaccggacactttagaagtatattcatcttaccggtcggaaaccggtaaaatgaaaacagcgggaccctgttgatcccgcttctgtagtcttactgacttaaatcctcttttcttttgtttatgattccttctaaccttgtaatcagatccagatcatcaatctgatcaatatagtgtgcgaacaaggagggattatgtaaaattttattcaaatccgtctcgatggaattcgtataatcttcttttgtgatcagtgttttatatcgtcttgacagtacggtaccgctgtaaacgatgtcggccacctcaatataattcttctttaccagacttctgagtgcggcctgtactgtatttacattcaaatcctctcttgcctttacaatctcagatgcgatcatcggctcatcagcttcccataacacatccattacctcaagttgccttttttttaattcacccaaccttaccactccttacataaaatgatttctatgaacatcctatcatatttctttgatatttcaaatatatttttcgaaaatattgtaaattttttatgtactttttgatttattcgtgtgaaacagattggtattcccttatttttctattttattggaaaaataagtatttttttcattttttatcgaacatattttctaaacatttgtttgccttttgtagtttcctgtgataaaatagaaaaaaaggctggggtcgcacagagaccttgggaaacaggaggacatcacatgggaaacggaacgattacagaaaagcaatccgagattcttgaatatataaaggcacagattttagagagaggatttccaccggctgtccgggagatctgtgaagcagtgcatctgaagtctacttcttctgttcactcacaccttgagacattggagaagaatggatacatccgccgggatccgacgaagccacgtgccatcgagattctggacgatgcgtttaatcttacgagacgggaaatggctcaggttccgatcgtcggtcgcgtagccgcaggtgagccgcttctggcagaacagaatattgaggattacttcccgattcctgtggagcgtcttccgaataatcagacgtttcttttacaggtaaagggagagagcatgattaatgcgggaattttaaatggagactatatcctcgtggagcaaacaccatcagcaagcaacggtgaggttgttgttgctcttgtggaggatggagcaacggtaaagcgttttttcaaagagaacggtcactatcggttacagccggagaatgatacgatggatccaatcattgtagacgaggtaactattgttggaaagatgatcggactgctgcgtttcatgcgctagacaatattaaggcattttaaaaggctgcaaaccattcacatggttttacagccttttcatattgacgacagcttataaacccggagtgtgccttttggcacttctggcggtgaagttatattttcatcgtctgttttggaaatctctgtcgtttagtcctccagctccccggcagagatcatcttcccatccttccagatacgctccagatcatagaaaagacggttctctttgtcgaatacatggacgatgatatcaccataatcaagcaaaacccaggttccaagaccataaccttctctttgttttaggatgaagccttctttggcaagctcctcctctacgttatccacaagcgcctgcacctgactgttgctggttccgtttgctatgataaaataatcggcaagaacactgatctctgagatatcaatcacctggatatcttcgccctttttactgtccagtgcatggtaggcgatggacgccattttttttgatagttccaatacgtgactcatccgtatcctcctttattgttcttctttctttaattcctgttgatagtatcgataggttttttctgtcatcggatccagtgtcaaattccgtgtctggagataggaaagcgtatctttcagaatcaggtaaaggcactcatcaatatcctgaaacgccagttttcgaagctccggcaaatgtggggcatcctttctccccggttcgatataatccgaaataaacaaaatcttgtctggcattgtcatatgcggttttcctgttgtatgacaatggatcgcgcttagaatcatctgatctttgatatggtacttttctgctgcgatataagctccaagctttgcgtgaaggaggcttggattcgcatattcactctccgtgatgtggatatgatacttcttgcagagacggatctttttcttcggtggtatacatttggcgcagtcatgcagaagtcctgcaatcatggcatcattgacatcctcaccatagcacattgccagggaggcgcttgtatacatcacaccaagagtatgttcgtatcgatcctgatccagatatttttttactttttttcgtatcttatgaattgcgttgctcatcttctatatcctccctgtacagatgatggttataaatataagaagccacactgggcggaacaagatggtggatgtccgctcctctttttaccatctcacggattttgctggatgacacttcaaaaaccggggcgcgtgaaaacaggatcactgttttataccgttccttcagatgacggatctgagattccaatgcatcatctgtctcccgatgttcccgcttggcggcgatcatagtgcaggatcgtaagaaacgctccggatgcttccaggtttcaacctgaaaaagagagtccgcaccgataatataataaaatgtgcgttcagggcaggcttctcttagatgctccatcgtctcgtaggaataagataccgttcgcttttccgcttcgtatgtctggaggaaaaagcgggggatgccctcgatcgcgagctttaccatggcaagacgatctcctgtccggattccggtctgctccggccgcttgtgaggaggatttccgtttggcataaaccagatttcatccagtccgaattcctccattacatgttcggcgagaatgagatgaccattatgaataggattaaaggttcctcccatgattcctgttttcatttgactacctcggaagttcgatttttttcttttcgtttttaccctctttgtaaagcacgatctttttgccaataacctgtacgacttgggaatgtgtacgttctgccaacatttcagcgattgctctcggatcatccgcacagttcttcaagacattgatcttgatgagctctctggcgtccagtgcctcctggacagcgccggtaagctctggtgtcatgctgaattttccgatctgaagtaccgggtccattgtcatggcaaggctttttaaataggctctttgcttcgatgtcatttgtatcttcctttctcttacttataatattcaaaactcagtccgtacatacggatggtatcaccttcctggacgccgagctcttcaagcttatcgagaattcccgtctccttgaggaaattctggaagaagcggaatcccttctcggaatccagatttgtgtaaccgagcatcttttcaatcttcggcccttctacgataaagatgccgtcttcctctttctccactgtatacggaagatccgctacgagaagctcatcctcagggaagaattcctgctcaaagatgactggctttgtatcgagtgttttaagctggttgttgacgtaccataaaagatcctgcaccccatctcctgtcacgccggagatagcaaataccttgtatccttttggctcaaactccgcccggatcctttctaccaggtcttggtctccctcaaagatgagatcggttttattagctgcaataacctgcgggcgttcagagagctctttattgtacttttccagttcactgttaattttgtaaatatcctcaatgggatccctgccctcacttccggatgcgtctactacatgaatcatcatcttcgtgcgctcaatatgacggagaaactcatgaccaaggccggctccaagggatgctccttcgatcagacccggaatatctgccaagacgaatccttctccatctgagagatctacgacaccaagattgggagccagggttgtaaagtggtagttggctatctttggattagcattggtaactctggacaaaaatgtagactttcctacattcggaaatccaagaagtcctacatccgcaattactttcaactccaaattcacccacagctcctgggcaggctgtccaggctgcgcgtactttggaacctgcatggtggcggtggcaaaatgctggttgccaagtccgccccgtccgccttttaagataacctgtctgcggttctcaccggacatatcggctacgatcttgcccgtttctgactccttgatgactgttccctccggaactcgcaggacgatgtcctttccatttgctccgtggcagcgctttttcttgccgttctcccccggctcggcgcagtatttggtacgatgacggaaatccacaagagtattgagaccgtcgtctacctcaaagattacatctccgccctttccgccgtctcccccgtccggaccaccgtttggaacatagagttcccgtcggaaactgacatggccgtctccgccctttcctgattttataaaaatttttgctctgtctgcaaacatctttcttatcctctcaaatcgtgttacagcttgtttctacttcattatataaagaaaaggtacaaaaaacaaggcttcaaaccgagctgatttgaagcctttgtatgtttttcgattcatagcgtcagcagatgagactactcagctaccgggtatacagaaacctgtttcttgtctctgccctttctttcgaatcttacgataccgtcagatgtagcaaataatgtgtcatctccaccgcgccctacattaacgcccggatgaatctttgttccgcgctgtctgtaaaggatgtttccggcttttacaaactgtccgtctgctctcttagcgccaagcctcttggactcggaatcacgtccgttctttgtagaaccaactccctttttatgagcgaaaaactgaaggtttaatttcatcatggtttacacctccctgaatctcaaatcaatgtattttctgtactcttcgttttcttccatgctctgaagtcctaaaaccatggatgaaaacaacaatgtcgtctctttagaaggagaagtgaaaagatgatactcaatccggccgctcttctcgtcggaagtgacagccgccttgtcctgtgtaaacgtttcgatagagttgatcgtattaattaccaaaatcgaaaccgatgcacagactatatcctctccagcaggggcataccccgcatgaccttctgtccgaaaaccgacatattcatgtttgtcgttctgataaactgtgatcttaatcatggattaagcgttgatcttttcaatcttaacagccgtataatgctgtctgtggccgtttttcttgtggtagcctgtcttcggtttgtatttgtaaacgacaactttttttgctttgccgtctccaagtacagacgcttctacagacgcaccttcaacaaccggattaccgatcttcagcccgtcgttgctcactgcaagaacctgatcaaatgtgtaagtcgtaccagcctctgctccgagcttttctaccttaatgatatcgccttcagatactttgtactgtttaccacctgttgctataattgcgtacatatggcacctcctattatcattactcgccagcttcggtgttcctttaggaatctttgaaacctcgctgtgcggcatactcatatataatagcatgtcatccatagaaaatcaagcgctttctagtaattttacagcattttctaataagatctgctttctttccttggatgacagatcaagagaatggaaataatggacataatccgtctgggacgcccacggggaatccgttgcaaagaggatcttctccacaccatgtctccgtacgatccgcaaaaattgttcatccgggatcttggaaaagcaggctgccgtatcgagccatacgtcttcaccaaccagaagttcctctacctcactccatctctggaaaccgcccatatgagcaagaacgagcttctgtggacgcacctgatgaatcacgtccctgattatggatggagtggcgtggacgaaattcggatatcccggatctaatccggcgtgaacactgacaatgagtccgagctccgacgcataatccaggatatttaaataccccggatcgtcaaaacgagtctcctgataatcaggatggagtttgatcccagggaaaccgttgtttttcagtgaccgtagccgatctttcagatgatcgcaggccggatgaatacctccaaaggaaagaagtttcccgtctgtctgttctgtcacctccgctgcaaagcggttgatggaatcaaactgggacggccttgttaccaccggaagtacgatactctgctcgatctttgcctcctccatggaggaaagaagagattcatatgttcctgacaggtgcgcccgctccccacattgccgctccagaaaggaaatggtcgtttcaacaattttctcgggaaaaatatgtgtatggaaatcaatcatttttcttacatccttttatcttgtcactcagatatccgatgatatcacgtcttgtcacgataccgatgaaaaaatgctggtcatcttccaccggaacgaaattctgctccatggcacgttttacaaggtcttccatatcacattcaatgctgaccggcagataatcgcatctgcgctctactttcataatagaaaggttttcggcctgtttgatattgagaattcctttttctttcagatcccagaggagatcgccttccgtgatggtgccgacatactttcccgctctgtttagaatcggcacgcaggaatacttataatgctccatgatctccattgcctgacgtactgtgtgataatcatagataaaagccagctctgcctttggatgcagaaaaaataaaatattcatcttcaaaaacctcttctactgttattctaagtattaaagctgtgtattgacaaaaatatcgtagatcgaccggatggcattctcaaaatcatgacaccgtaccccaatgatgatattcaattcgctggatccctgatcgatcatctttacattgacatttgcatgtgaaagcgctgcaaaaatacgacctgacgtcccccgcgtctggcgcatcccacgtcccaccacggcgatcagggcaagatcggattccaattcaatgaaatccggcgataccgcacggtggattccggcaaggattttctgttctttactttcgaattcattttgatgaacgaaaacggtcagtgtgtcaattccggaaggcatatgttcgattggaacattgttttcttcaaatacctgaagcactttccggcagaatccaacctccgtattcatcatagccttgtcaatagtaacagaggcaaagcctttcttaccagcaataccggtgatcgtgtaccgtgggtggcggcaggtgtcctcaacaatcagcgtacccggatcctgcggccgatttgtgttgcgtatattaatcgggatgccctcgcttcgtacagggaagatggcatcctcatgcagtaccgtcgctcccatataggaaagttcccggagttctcggtaggtgatggtttcaatcaccgcaggatctttgatgattcgaggatctgtcacaagaaacccggatacatccgtccagttttcataaagttctgcgtggacagctctcgctaccagggagccggtaatatcggatcctccccttgaaaaggttacaatccgtccattagggtcacttccgtaaaaaccagggactactgcgtgaggaagcacagacagacgttcatagagcatcgtatttgtcatttccatgtccagccgtccctctctatcgaagaagatgacttcggccgcatcgacaaactcaaagtccagataagcggccataatcaggccatttaagtattctcctctggaggctgcgtactgctttccgacctttgcttcaaattgtgttcggatgatctcaaattctttcgctaaggaaagcgtcagagaaagtccacttataatttcttcgtaccgtgaggtaataaatgtccattcttcggaatagtcccgcccacttgatgctttttcataacacagatacagcatatctgtaattttgatgtctttggagtcttgctttccaggtgctgacggtacaacatatttccttgatttttcactccggatgatttctcctgctttttgaaattgtgccgcacttgcaagagagcttccaccgaatttcactactttgggcataataaatcgctccttcatttatcgattgtgcagaatctcctcaacaacagacggaccgaagacgacgccatggatcccctcccggcaggcagccactacattgtcttctctgtcgtcaaagaacaggcaggatgccggattcagatcataacgtttcagaagaatccggtatatccgggcatccggtttgagacatttttctttccaggaaaaaactcctccatgaaaggattcgataaaatgaagtctgtcttttgtcttttcataaagcccttcggaatagttggagagaaaataaatccggtatcctttctcacggaaccaacgaatcagatcttccgtatagtcagccggaagaatacactcgcaaagaccttcgtatacaagacgaatctcctgttcaagttggggtgcgtttgcaacaaaggcgtcacaccaggtttccggtccgtaagtaccccggtctccttcaacccaggcagaactttgaaagacggcctggttgatccggatttttgttttcttgtcaaaatcatactgatccagacagtgatgagcatcgtagtgcaccagcacatttcccagatcaaaaatgactgtattacatgtatctacaggtatcttcattttgttctcctctttgtctgattctccactatgtactactttacattgttaaagcggggattgcaagaacaatccgctacttttccaattttctgataacatctgcgtaggaagctttggcagcgattttaaaatcctctggagcaagtttcaactgcattcccagttttccgccacttacatacatcttggtaagtttcgacgcatcttcctggatgatggtcggaaactgctttttcatgccaatcgctgtacatccaccacgcacatagcccgtaacggttgtcagagtccgtaccgggaccatctcaagagatttctctccggcagcacgggcagcttttttcagatcaatttcttcttcaatcggaatgacaaatacataatatcctccgctctttgcctgagtcaccagtgtcttgtagacctgttcatggggaagatggagctggtctgcggtggaaatgccatcggtaaactgctcgcagtcgtaaatccggtattcataaggaataccaagccggtccagaattcgcatggcgttggtctttaattcttttttactcattgcttctctcctttttccggatcgcttcatacaatggcgggcggcccttttttcgtgtgatctccatcagatccagctttgtcaggtcaatcacctcggtcttgacaggatcggctgcggtcagctcccgcatcgtatgaagtaaaagctcccggtcttcctgaccggatagattgataaagtcaatcagaatgatgcccgacagattacgaagccgaatttgccttgcagcttctttggcagcctccagatttagtttcagatactgctcctgatttccggaaactgacctgcctgtattgacgtcaatcactgtcaatgcttctgtaggctgaatgataaggcttccgccggatttcagccagactttctgggaaagggcccgatccattacctgttccagactatagagctttgtaagggggaattgtccgtcctcgtagaaacgcaggcaggataagatgtctggttctttttccagaagatacgcccggattcggtcccataccttaggaatgtctgtgacaatttctgccagagactcccaccggacatgagagaatccggcaagaataccgggatcactctccataagacggctgaaacaagtccgggtctttgcccggtcaagaagtcctatcagccggttttcctgtgtgcggatctctttggaaagttcttctttgggaagttttgcagcttccgtccggagaatgactccgcaggaagatatagccagatctttcagccagtttttcagtgtttctcgctccttctttgggagtttggaggagacacctggttcgtgtggccgcatggaaattactgcataacgttctgtcagggaaatattggtcgtaaccgaaggctttttggatttggaggcctccttattgacctgtacgaccagctcgtctccgacacagactttctgttttccgtttttttttgtaaagcaggcacaggcagtttcctcttcggtacagtaacattccataccgggaaacaattcgatgaagacggcatggatattcggaatccgtcgtttgatccttccaatgtaaatatctcctacctgcacggatgcaccgtttttatcgtcctcatctgagacaaggatttccgttatttttccgtcatcctccagaaagaagcaaaggcggtcatacacattagttacaaggattctctgttttgtcataaaatctccgtccccagcgcgtcaagtgcgacgagctgttcatcctttacggcatagttttctaatctgtgatatcggaaatcctgttcggcgtctttatcgactctggacttgtgcagaagggcggatacgacaagctccggcttcagattaacggagcttccggcccgaactttcagaaagagactgttttctctttgttccagttccaggatccatggtcggatatttacttccttttcacttttctttgtctgctttacgacgaggatttcctcactggaaagaaaagcgacaagatcctcagaagagacaggaaactttccatcttttggaaagaccagataatccgccgcctcaataatagacattcctgtggactttttatcctcaggaatctgtacaaaatttataatttcgattccatcggccataacggcattaagcctttgaatggcatccctgcttgcaagcggtcgaatgagttcgatatcaaaatattccccgtcgcttgtcagtcccacgccaaggggattggcaaaggacatgatcatatgagggctgaatccctttgtaaaggcgattggaatgtccgctcttctcatagctttttggaaatagcgcatgacgtccagatgaccgataaatttcataacaccatattttcgaaatttaattcttgccttcaaagcagacacctccctgataacacattgctccgcaggcagagcatttttcccggcagttcggggtgacttcccctctcatggcacgctcccactcccgcctgaggaatgattttgtaacgcctacgtcaatgaaatcccatgggaaaagttcgtcaagttctctctttcgcatggtatagaatgtcagatccacccccgtattttcaaatgcctgcatccatttatcattttggaattcatcgctccaggaatcataaagacatcccagtcgataggcttccagaagtacctttgacgtccggcggtcgcctcttgcgaaaacaccctccagaactgtcacatccgcttcatgccagttgtagcggaggctctttcggtttaattgctctttcatctcctggtttactatgtaggcacggtggatatagtcttcctgggtgaacatctgggcccactgaaacggggtaaatggttttgggataaagaaggaggtgctgaatgtaatctggcatttcccatttctctggcttttggggatttcatagtattttctggcgacacgatccgccagccgtggaatctctttcatgtcctcctcggtttctcccggaagtccgagcataaaatagagctttactttgttccacccgcccgcaaacgcttgagccgccccatccagaatcatttcctcggtcagccctttattgatgacattacgcatccgctgggatcctgcttctggggcaaaggtgagactgctctttttgatatcctgtacttttcccatcacatccagggagaacgaatcaatcctcagggacgggagggaaatattgattcctttgtccttacattcttccatcaggaataatacaagatcctttaacatggaataatcgctggaacttaaagaactgagggaaatctcctcgtgtccggtatttttcagcatctcgatagcataacgctttaaggtctccagatttttctcccgcgtcgggcggtagatcatacccgcctgacagaatcggcatccgcggatacatcctctttggatctctagaacgatccggtcctgagtcaccttgatgaaagggacaactggtttggacggatatggtgcatcgctcatattccggacgacttgttttttaatcgttgccctggcgtgtgaattgttcggaagaaaggatttcaacgtaccgtcttcgtggtaggacacgtcatagaactgcggcacataaattccttcgatctccgctgccatctccaggaaatcgcgtctcgttccatgattctttttgttttctttgtaggcatccagaagatcattgtagacagtctcgccctctccgatatagaagaggtcaaagaaatccgccagaggctccggattgacggcacatggccccccgccgataacgaccggatcctcgtctgtccggtctgacgcaaataacgggatgttcgaaagatccagaacctgtaaaatgtttgtgtaacacatctcgtactggatcgtaataccgagaaaatcaaaatcctggatcggatcctgggattccagagcgaacaatggaatatgttgctcccgcatgatccggtccagatcgatccacggagaataaacccgttcgcaccaggtatcctctctccgattgaacatgtcatataaaatttgaattccaagatgggacatgccgatttcatacacgtccggaaagcacatcgcgaaacggatagctaccttttctttgtccttcatcaccgaattgatctcgttcccgatatatcgggccggcttctcgatattcagtaatatttcatcatttaaagctagttttctcattttttccctttctgttttatgggttatattgtatggaatcattctctgtggtttgtatgaaaaaggatacaaaatatcaatttggaagttttttcaaacataattcaatcgtaaaagccagtatattccgtaataagattttttgtttcattttaaattttaaaattcaaaagaattaatacaagaaaatactatgcataattataaagacttagatgatcctatacaaattcaatctttaacattataacattttgaaagataagttcaagaagagaaaccgattctatatcaggaacttttataattatcacaatgaatatcaattcaatttatagagccatgtctgataagcttatacagctaaatgacgatttataatagcttagtaaaacaaataattctatttgcttctgtaaaattcatagccttgtgaaaatgaagactgtttatattatctatttcacaatcgctggcaaactcttgacaaccgtttcctttcgcccatacttcgcactcggttaataattctttggcatatcccttactacgatagctttccttcacaaaaattccctctaaataaccaactggagatgtgcttgtaccttccacataatcatatcttaattgacattgtgcaaaacctataggaaattcattttcatatttcaaaaaaaattgtgatttcccatttatcataatttctgaaaattcattgattagttcattgatagaatggttgtgccacatttccgaagctaattttgctagtgtttctaaatcattgtttcctgccttttttatcatacgctctcccttaaaaatccaatttgtctttagaatcattatatcatgcctctttcagcattgtcattccttttctgcttttaaaaagctgcttattagcttctgttttgtagtttcactgcatagaaaaagacactctatttcaagtgtcgttcttccataactttgtatttccttgtataatctgttatttaaggatctttcatttgttgtaattctgttgtaaattgctttcttttaactgttcctctgatagatttagtttttatacgaatgtttccaatttttcgcccgttttcgataaaaagatcgtcccttcccctgctggttactataccggaacaatctcgatccagtatccatccggatccccaataaaatagattcccatttctggattttcaaagagaatgacacccatttctttatgttttttataggcttcttcatactggtccgtcacaaaagcaagatgaaattcctcatctcccaggtcatatttctccaccctgtccctcagccaggtcagttccaatgtaaaatcaccattactgtcgccaagataaacaagaataaaacttccgtcttccgcttcttttcttcggacttcgtgcagtcccagggcttcctggtaaaattgtaaacttttttccagattcaaaacattaaaattaaaatggttaaaatgaaacatttctttcctcttcctttgcggtttctgtctgctgttctgaagcgcggagaagctcatcctcctcatatacgctgtgatcctgtggatccagcagatacttcataaactcccggtccgtatattccgtttccagaaattcgctgaaacacggataaatcagatcgtgaaatcctttctcaaacaaataatcttcaaactttcctttatagtttttgctctgcttacgttgttgccgccaatcttctgctgcgccggaaagttcttttaatgtgattccgtgtgtaaacatccaccacatctggaatttggcgtaagcctttctgcgaaatacttcccgctcggaagtattttcctcagacattgcgtagtgggtgagaatttcacggttccttgctgtatccagatagtactgttcgaatcccttgccaagattcagatcatggatcatcacgattccgtccatctccgcaaaacggaccgcgtcctccagcgacatatcggcctcgctggatgtattgatgaatttggcaccatactgatctgtatccagtatatagtgagtcggacgtgaccaaaaagcttccatgaggatctggactttttctgcaatgatctctgcccgacggttggtattgccgtatttggatcctactctattgcgaacccgcacatatgcataaccaagaagtgcttcccggtttggtgccatcgttccgataatccctttgagcgctctggtggcacagacccgttcccctttcgtaatctcatcctgaatctgcaacagtccctgcttgacaaattcatatgtattcctagtgaatttttgcatgttgcttccccctgtttatctaaatgtattccttctaagatggaaatatgaaacaagatcacacttgcctgtcaggggctcaggttaacaagttccggtatttccgttcccgcagagatcttccgagaagatgggcctgttgtactataaatacaaaatatggcacttgtattataatatatgatacatcatgtcgtcaacacaggaaagaatttcctggaaacccgatttcttctatctctgctttgtcttttgcccgatgcctgcctatttggggacatctatcttgatacggggatctcttttggagtgccaacctcctcttttgtcttggcattcggataaatccgttccattctggcatcatcaaaataggtatccaacaactgatcaatcacatgatccgaccgttcgcctgcagtgcgatgattgtatcttacaagagccgccgccgacaccagcatattgacggacatgaaaacgatcaggcaccaagtcaggatatgtcctgtgattcttggaatcttttcgatccagccagacacacatggatacagtactttgatccacactacggccgcgataccccagaaaaaacaatagagcagattgattcgtccgcccagattgaacggaataccagtatagtcccaaaagacacgcccaaaaaagagttcggaaaagacgctgcataaatactcgtaggctccgccccagaatgtaccgacgaaaaagaggtatcggtcaggcttgtctctatccttgtgaagaaggattgttgccgccgcaatggccaaaccccagacgatgctgaacggtccccaaacaaggctgcttctgctcatccagacccctgcggtgatccgacagaagattgtctcgacgatgtctcccatgaaagaaccgatgacaaaaagccatacgatcttatagaaacagcagccttccgcaaagtgcccttctttttctatatcctttctcgcctcttggatcagtggataggcccgctccattcttcgttccacatggttgacaataaaatgggtaaaccggcgggtgacaactgccacgctccggttccatcgtaccgctgctttggcaggctttccgatgtggagagccgcggccgaagagacggacatatcgactacaattccaatgacagcacctccgatcaaaagatctccgaatggctgcgggatcagatgaaacaaatcggtaaaatccgagtccccataacggacagcgagcacaccaagcgctccccacagaaggctgtattggagacagatatatccgtcaaaattccatcgttttcgggaatagtcccaccacttctgctggttcagccgttccagaatcttccccgcaaaccattcgatcatggtggcaatagccatacagccaaggaagagaaagaccgggcgtctttccagatcctccagggcgatgatcattatcacagcggctgtcccgtaaataaaacagaacggtccggatgaaaatccacggtttacgaatttcttttttcggatagtgccgacaatcgtctccacaaaccatccgagaaacgaatagattagaatcagccaaataatctcagaaaatgtataatgcatgtctactcctgctgtcgaaatttatcttttgtactcctgtttcatgtattcttccagtgcatcaatccaggtcggcatctcgtgaagtccgagaacctgaatgagaaaattgtcaaggacagtaaaggttggccttgcggaacagtactctgctttcttggttctgacaggaatgattttcacatccttttttgcaagccgcacaatttctttcgcaaattcatatctgttgcagacaccgctgcatgtgacatggtaagtcccgtattcctccgatccgatcagatgcagcatgaataccgccagggcattggcgctggttggggaaccatactggtcatcagatatatgaagctctgtctttgtctcgatggcatccaggatctgattcacaaagttcgttcggctgccgcgcccgaagacccaattgctccgtataataaaatgatcgtgggcaaactctttgacataattttctcccgccagcttactctttccgtagaccgtcatcgggtctgtttcatcaaactcatggtacggcacctggcggatcccattaaatacatcgtccgtggagagtaaaaggatctttgcctggatcctggaggctgcaatagcaagatttcttgcacccaccgcattgaccttaaacgcatattttggagaatcctcacagacgcccacatccgtgactgccgcacagtcaaagataacatccggctggtgttccttcacaaatccaagtacctgacttaaatctgtgacatctacttcatcgatgtccgtattcagaagctcagcgtccggccggtgctcctttgccatatcgttcaacgcgcacccaagctgtccggccgcgccagcaatccatatcttcattttcttcacctgatttctctacttttgtagtggattttccttttccggaaatttttctttcagcgccttcgcgacaacttccggtacgtaccgggtcgtatcagacccataatacgcaaactctttgaccagtgtagaacttaaaaacgcatattccagactggtcgtaaagaacatagtgtcaatctcctgatccacactatgattgatctgagccaactgcatctcatattcaaaatccgtaacagcccgtaaaccccggatgatcagtcttgcgttgttctcctttgcgaattctacagtcaggccctcgaatgccttcactgtcacattcgggaactcctttgtcgcctcctgcaaaagatggagacgttcgtccatcgtaaagagcggcgttttcttctggttgatcaggacaccgatgatcagttcatcgacgactttggacgctctcgtaatgatatcaagatggccaaatgtcaccggatcaaagctgcctggatatactgcttttatcatctgcactcctcatttcatggaaatttctccaataactatactacaaaatgtgggacaggtcaaactgtttcaaggaggccggaatatcaaatggagcctgaatctcatggataatttccgtccgccttggtatagtcttgggaagcgtctcttcatccagattcagaaaccctgcaaacagcagaatacttaccatcaggcggatgaaaaaagtgctatgtggccgctcttcgtcttcctggtaaatactttcgtaggccgcccgataccgtggatggacggccggcatccgaaaggcttctccggaccttagctcctcctgtctgtggatctgttccagagcctcttttcgttttctctcccggttttcactcatcgtttacacttcctccattacaaaagacaggatatattactactatataccctgtcttctttcagtatgctaatggcggtccgataactcccggataatatcgtcccaagtcaggccacgttccgccatcagtaccatagcatgataaaggaaatcggccaattcatatttgagctcttccgtattcggatttttcgcggcgatgatgacttcggccgcctcctcccctacctttttcagaatcttgtcaatgcccttgtcaaaaagataatttgtataggatccctctttcggatgtttcttgcggtccaaaatggtatcgtagaccgactggaagatctcaagcgggtttgtctcgtcgtagtctgtcccggcgatcgtctggaagaagcatgtcggacttccggtatgacaggcaggccctatttgctcaacttttgcaagcagcgtatctttgtcgcagtcgatagtcaaagattttacgtactggaaatgaccggacgtctcccccttggtccagaggctctgtctgctacgactgtaataggtcatctttccggtctttactgtccggtcaaatgcttcagcgttcatataagccagcatcaaaacctctccggtcttataattctgtgccactaccgggataaggccgtcggaattcaatttgaaatttgagaaatccaagacactttcaaaagaggtcatctgaattcctcgatcccggcaaagctccttgaatttgtggtaatccatctcctcattgcttacgaacttccctgaaattcccctcgctcccggacttttcaggatgcggaagatttccgattcctccatcgtatccgtcacaattacatatggaatctcagtcagcgtcatcacagaattgagatccaggcggtgcataaaaataatctcgctactgttttgttcaattaagtgctgatgtttgaacagggtatcaaaatcatttaaggaagccgcgattttctcctttccgaaacgtcctgccgcctcctgaatcaactttaccgcaccggtacgggagaaattcagcactactcgtttgacgccggcgtagagcatcttcttgacatcttccaaacgcttgatatttccgcctgcgacaaccggaatcccgacaaattttgtgatttttctcagaagatcgatcgattcttcgtggtcctcatcggaatccgacaaatcaaatacgagcaattcatccgcaccttgatcgctataatgctttgcaagtgcgatggcgtcctccgagagaagttctctgtcgtcaaaccatctgactgcctttccctgcagtaaaaaaatgcacggaatgattcttttataactcatctgtttttgttcctttctgctataagcttcctttcgtagaccacacttccgtcatcccgggttcataggagacagacatgtgaagggcttttccgaagcctttaaagagggcttctgccatatgatgattgtttccgccttccagaagtttcagatgcagattcatcatcgcactgtaagagacggcatagaaaaattcccggatcatctccgtatccatctccccgatttttcctgtagtaaaatccgcctgatagttcagatacggacgtcccgagaggtcaatggcacaaagcgcaagactttcatccataggaagaaggaaaaatccgaaacggcggattcctttcttttctccaatcgcttcctttatggcggttccaaggacgatccccacatcctcaatcgtatgatgagtatccacctcaagatcccccgtcacctgtacattcagatcaaaaagaccgtgtcgggcaaatccatacagcatatgatcaaaaaaaccgattccagtctggattgttccctgtcctgttccatccagattcagatggatacggatctcggtttcgtttgtctttctatagatttcggcaatccgttctgtcattatgattcctcctcttcaaaccgtacccggatcgagtttgcatgggcggtcagttgttctgcctcggcaaaatactcaatatcctgatggatctttgaaagcgcttccctggaataagaaataatgctggatttttttataaaatcgtccacggagagaggggagaaaaacctggccgtcccgtttgtaggaaggatgtggttcggccccgcgaaataatctcccagcggctcacttgcgtattctccaagaaagatggccccagcgttcctgatccgcgtcataatatcaaatggattctttgtcagaatctccaaatgttcacttgcaatctcattcgctgtttcgatagcgtcctccattgtcttcgccacaaggatataaccgtaattgtccaacgatttgcggatgatatcggcccgggaaagggtgtttaaaaatccgtccacttcttctgatacctttttggccagctcctcgcttgtcgttacaaggatggcggaggccagctcatcgtgctctgcctgggaaagaagatccgccgctacatatctcggatttgccgtctcatctgcgatgacgaggatctccgaaggccctgccacggaatcgatgctgacatagccgtacaccgcttttttcgcaagagcgacatagatatttccaggtcctacgatcttatcggtttttttgatactttccgttccataggcgagtgccgcaatggcttgggcgccgcccaccttgtatatggcgtccactccagcttcttttgccgcaacaagggtgtgcgggctgaccgttccgtccggtctcggaggagtcaccatgatgatttcatctacgcccgcgatccgggccggaatcacattcatcagaacagaggatggatagaccgcttttccgcctggaacataaacgcccacccggtgaatcggagtcactttttgtccgagcatggttccgtcaggtttactgtcaaaccaactatactgcttctgtttttcgtggtagcttctgatattttcaagggcttttcggatcacctggataagagaagcctctgtctgacggtaggcatcctcgatctcctgattcgtcacccgtattgtgttctttgtgaggtctgcatgatcaaaccggctcgtataggaaaagagcgcctcatctccgttttcctttacgttttttaaaattgcggcgacacgatcctcgtattctccatagctgtcaggacttctctttaacagttcctttaagagattctgcatcgtttcttttgtcaatctctggattctcatcttctctcctgcctttactgtaatatttctttcaatccggtaatcagctcccggattttgtcattttccattctcatgctgaccgggttgacgatcattctggcagaaagcggacaaaccttatcaaggacacaaagtccgttctctttcagcgtcgttccagtttccacaatatcgacgatcacctcggaaagccccacaattggagcaagttcaatcgagccattgagcttgatgatctccacagtctgatgtttccgtccaagaaaatagtcttttgcgatacgcggatatttggtagctgcccggatgatctcccgacgtcctaacagctcttttgcgctttctggcccgcatacgcacatgttacatgttccgaatttcaaatccagtacctcgtggacttttcggtcttcctccagaatgatatccttccctactacgccgatatcagcggcgccgtactctacgtatgtcggtacatccggacctttcgcaagaaagaatcgaagctttaagtcttcatttacaaagatcagcttccgtgaggctttgtccttcatctcttcacaggtgatgccgagtttttccaaaagctcaagcgtctgtttagcaagccgccccttacagagggcaaatgtcagatatctcatgtcgttggctcctcctttttcccggacgccttgcgctcccctgtcttcagattgatcatctcgatctccccgtcttcctgaaggtaaagcagcgtttccgcctgatttttctttccgtactggatataatcatccagtgtttcctttgcttttttgcagaaaagctctgtgctgttcttccttgcccggaattcttttgcgagactgactgcctgcctgcgctgggaatccgcataaacaatgatgacattattctcctcataagaaatctggacatgctgccttgcaagggaattcatcagctcgtcaatgatgacggcaaatccaatggacggggcacgctttccgaatttctccatcagatggttgtagcgtccgccttttacaatagcgtctccggtgccgaaggtgtaagctcggaatatgaccccggtatagtatccataggtaccgctcatactgaggtcaaaagtgatatatttctgtacagtgtacgcttttagaatctcgtatgtgtcacgcagacgcttgatggtgcgcttggaaagctcgtttggcgcaatttccatcgctttctcaaggacttccggtccaccgaccagttcctgcagatgaccgaagagctcttttatttctggacgcacacctgcctcgtccaacaactctgtgactccgtaataattgcggttggaaatgagctcccttagatattcttcacattccggaggaagcttcgcctcttttaacaggctgtttaaaaatcccacgttacctacgctgatctgaaaattctcaagaccggactgccgcaggcagtctactaccatggccagcatctccgcatctacatctttggaatccaatccgataaactcagcgccaagctgagtattctcccgaagtctcccttgataactggaataattgataaatgtatttcctatatagcaaagccgaagcggcagttcttcaatttcatacagagcggaggccgccctggcgacagatggtgtgatatccggacgaagggagagaatatttccttcccggtcaaaaaacttatataattccttgaccgaaatactgccgatctccttacggaacacatcgaagtattcaaaagtcggcgtctgaatatcgtgatatccgtaaaggtgcagcacatgatgaagcttttcctgaagcgccagcttcttgcgacattctactttgtaaatatcccgcaccccttccggtgtgtgtaaaatcttttgtttcatcttttctccactctttctgttttttctctcactttaccgtgctactatgctaaattaaaagtacaacgcttattataaaaatcttactctcttttgtcaagatctttctggatttcttccagatacggaacaaagcatccatttttcaaagaaaagaaaaaccccggatccagttcctcaaagcggatacttttacgcccgcctcctgtcatgcgctcccagaatttctttaactcccggaaacgcatatagtatagctgattcctcccggtatagaggataagtaaaaaagcaattccgctttgacgctcaaattcctccatgaaatccacctggtgccggtggacattttgtagaggaaaggtatccgcagcacattcctttgcatcaaagcagaccggaatgccctgtacagctccgatatagtccactgtgcttcgctggtcgaaataggccaaagtaatgtgcctttgttccttgtcgatctttaccggtgtgatgggagtagggattttctggatcaaggcaagccctctgtttcgatactgttcatttgtatgattgatgtagtcctccagggcagatccccgcagccctcttgatgtccatgttcccatcctttactgctccttttccaagtactgatgaaggatcttcgcaaactgccgtggcacttttgcaaggatgacccgccctgaaaggctcggcaggtctggaacctcctctggaaattccatccggtaagcatgtaagagctgatgagtcagtccgaattctttctttgcccggtcgtttgcggaacgctttccatatttatagtcgcccaggaccggatgaccaagagatgccagatgggcacggatctgatgggtccgcccggtaatcaaatgaacttccagaagcgtaaaatccgttcctgtctgaatcggtacatattctgtctcaatcgggacacttccctcctgtctgtcggaaaaaaccgtcaccttattctggttttcgtcctttttcagatacccctttgcccgaaccgattctttcatctgcccacagacaatcgtacggtaatatttccgcaccgagcggttctgaatcattgtgctgagtacctgcaagcctttcagactttttccggctgtaacgattccgctcgtattccgatccagacggttacagatggatggatgaaaacgcagaagctcttcctgagtaatcgcctgggtctttagaaggtagccggtcagccattcaacaagggaaaaatctgttgcttttgctttttgcgaaagcatcccacatggtttatcaagaaaaagcacgtcctcatcttcataaatcacggataccttgctcgatggtatgtttgtgtcggtctgcataagctttggtgtatgcatttttgaaaactttccaatggtttcttcagagaagaacatctgaatctggtcgcccagagcaagatgttctttgccggtcattttctttttattgagtgtgatgtttttctttcgcatcatcttatacagaaagcttttaggcgccaaaggtaaatacttggtcaaaaatttgtccgccctctggcctgcgtcgtttttttctatgttgatcgtctgcatctgcttctcctataccacggctgttaaaatcagcctgcacatgtcttttgccggacgttgctcctcttttgcacgctccggttgggagccgatttctccaacccgcttataaaaagcgtcatagtcggaaaagagttttaccgtcaccttttcatagtgattatcccgcaggatttttgcaaggtacgcttctatttccgaaacaggtgcttttgtctgagcgacatatccacaaagcagatgtttggaaacaagaagagcatccaccgccatgatcttttctgagctggtaagaaccaggtcgaagatcaggacatttcccggtgctgcctccctgacagcctttaccttttcttcttccagggaacgatacggcagcagtaagatcatacttacagcggatctggcggcaggcaggcatcccaaaatcgccacaatcgtcaggagattgttccttgtgtgcgtcgtcaggtatccggcaagaaagactgcgatactgattccaaacagcaggatcgtaatcaagattcgttttttcttctggctgcggatataacctgacattccttttgtaatcttcatagttgctcctttatcgtatccatttatccatggctgagaaaagaatctcttccggaacgagctttcctgcaatgcgggctcctttcatcaacgctccgtggacagaaagcggttttttcatccgggagtccagaagcgcggttctaaccacatcgcaggcagggaccatcaccgattcctttatcttgctgtgagtggttccagagacgtcaaagaactcggtatccaccggacccggacagactgctgtcacgacgatgccttcctctttcatttcctcataaagccctctggaaaaactggtaacgtaggcttttgttgccgcatagacagtaaatccaggctgtggacaaaagcttgctccgctggaaatattgaggatccggcttcctttactcatgtacgggagcacaagaaacgtcatccgggtaagggaacggcagttgacatcaatcatccgaagctgcacagccgcgtcctcttttgcaatatgagcggaggatccgatctttccgaatccggcagcattgacgagcatccgtatatccgggctttgattttccaatcggtttaaaatctgtttgtagaccagatctttctccagatctcccgcaaagatcctcacatagacaccggtacgcccctccacttcctgtttgacttcttctaagcgttctcctcttctggcagtcacccagatctcatccaggtgtttataaaatccgggaatttggttgacgaactctcttccgatcccggaggaagctcctgtcacaatcgctattctcatatccatccctccctcattctcagtgttttttctttttatgtgtatttcgtatcgttttcttttttttcggcagggcagattccttcccttgctgcctctttttcgcaaaataccggtcttcctttgtctgtcttggccggatcagacaatgctttccaaatccaatcagatcctcccgtcctgttttcctgagagcctccatcacaagctcatagtttttgggatttcggtactgaatgagagctcgctgcatcgccttttcatgtggtgattttggtacgtacaccggcttcatcgttcggggatccacaccagtgtaatacatgcaggtggaaatggtagacggcgtcggatagaaatcctgcacctgctccggcatgtagccaagatcccgcaggtattctgcaagcgctactgcttctttaagggtagagcctggatgtgaggacatcagatacgggacgagatactgtttcttaccgatctgttcgttgatcctctcatattttttcgtaaacgcccggtatacggcattttccggtttccccatcatctgaagtaccggatctgcaatgtgttcgggtgcaacctttaactgtccgctgacatgatactggcaaagctcccttaaaaaggtgtcgtcccgatctgccatgacatagtcaaaacgaataccggatcggataaacactttcttcacttttggaagctcccgcaaacttcggagcagttttaaatagtcccggtgatccactttcagattgccgcatggttttgggaaaaggcactgccggtgcttacatgctccatgggtgagctgcttttcgcaggccggatgccggaagttggccgtcggacctcctacgtcgtgaatatagcctttgaaatccggctcttcagtcagtttctttgcctcttctataagagattcatggcttcgtgtctgaatgattcttccctggtggaatgtcaaagcgcaaaagctgcacgccccaaagcatccacggttactgataagactgaatttgacttccgagatggcagggattcctccatctttttcgtacataggatggtaagtacgcatataaggaagagcatatacatcatccatttccgtttgggagagcggctttgcgggaggattttgaacaacaaataaatgatccgagtatggctcaatcagacgttttgcggtgaacggatctgtgttgcagtactgggtataaaaacttttcgcataggaaagtttatccttctgaagttctgtaaaagccggaagttccactccatcgtaaaccatctcccggtctctgaccttacaaaccgttccatccagataggtcagatcctccacccgtattcctgactgtaaggcatcggctatctccacaatggatcgttctcccatcccataggaaatcagatcggcgccggaatccagaagcacggaccgcttgagatgatctgaccaatagtcataatgggcaagtctcctgagactggcctcaatccctcctaaaatcaccggggtctttttatatgtctgacggatcagattgccgtagacgacacaggcatagtccggccgcttccccattacaccgcccggagtgtatgagtctttgcttctgcgtttttttgaaacgctgtaatggtttaccatagaatccatatttcctgctgatacaagaaaagcaagccttggttctccgaatacagtgatactttctttgtctttccagtccggctgtgaaatcattcctacccggtatccatgggcctccagaagtcttgtgatgatggcatgtccaaaggatggatgatcgacataagcgtctccgctgatgtagacgaaatccacctggtcccatccccgctcttccatctctgctctggtgaccggtaaaaatttattctccatcggtacccctctctttgatctgcgacattacgtcccggaaatcccggacatagtagtcagccagttgtttcttttcaagatccagcagccgggaaaattcatcgtagacagcgcacactttcatccccgcccgtttccctgcgagaatccccattggcacatcctcaaatacaagacaatgctctggctgtacctgcatatcttcggctactttcaaatagatgtccggctttggttttccggcctcgacttcaccggacgtccggacagaagtaaagtactcctcgatccggagcgcctttagagcggcctccgcaagggtccgtccgttgctggtagcgataccaaaaagaatcccccgctcctttccataacgtaaaaactcctctgcccccggctttagtgttacctcttgcgtatatcgctgataagcaagggaagtccactcttccatgatctcttctgttgtcagctccatatcaaaggtgtcccggaaataccgtgccgtctcatggtaggattttccttcaatcgcccggtggaaatcctccggaagcgtcaggtgatatttcctgatatagtaatcgtcgatatccggccatatccacatagagtcgatcagtgtcccgtccatgtcaaaaatgaccgcttttgtctcttcggtgattgtttttttcatgttaatctcctttatctgaactgccctttaagcgggcaatctcttcttccgtcagtcggcgcacctctccctttttcagttgcgggtccaagatcaggcttcccatccggatacgtttcagataacggacttcctttccgacagcctgaaacatgcgtttgatctggtgataccgtccctcctgaatggtgatggcgatttctgagcgaagcttctcccggtccacttcaagaattttcaggactgcggggagagtcagggtatcatccccgatatcaacgccccgggaaaaaagtatgacatcctcgtcgcctacaattccgtcaatgactgcctcataagttttgtccacgtgcttctttggcgagaggagacgatgggaaaactctccgtcgtttgtcaaaaggagaagcccctccgtgtccttgtcaagccgtcccaccggaaagacgccggtacggaccggtcgttctaaaagatccagaacagtcttttcttttttgtcttctgtggctgagacaacgcctgcgggcttgtgcatcatataataaacaacaggctcgtagcaaacatttcttccctgacagcggatcgtggctgtctgttcatttactttctggtccggtattttcacaatcgtaccattgacactcacctggccttttcggatgagtttttttacttcttgacgggtaccctctcccatctcagtgagtagtttatcaaggcgcatcatactgactgccatctccatcccggaaggtatttgtttttcaatgtgccctgagacaacttcccgaacccgagcggatatccgtccacacagacgagataccagcctttttctttcgatcctgccaggtcatctacgagcagagtctccccttttaagtaccggatgactcgttcatccgataccgggaaatccagaatatactcatactctccctttttcagattcatggcaaaggcctgacttggctcgaatctgccttttttgagttccccgatcagaaggccgcttctcaggaaacgcacgccggataagttcggaagcccatccggcatatagtacacccggtctttacggatatcaaaccgggaaacatcaaatgaccgatgaactttctttaaaaatactctcagatcttccggaagtttctcataggaacagccacttttcgtccgttcctgttttagctctttccttggaagattctctttgtcctctttttttaacagaagagcaaggtaatgcccctctcctttcatgtggtgtgggaaaatgcgtacggtctttgaaaattcttcttttcttacagaagcatattctggtacgccctcacgaaatccctcgtatgggcggatatccacaagatcaaactccgggcactgctctaacagccaggaaatgctcccctcattttccaggggatcaaaggtacaggtagagtataaaagcattcctccaggccgcaacatggcggcggcctgggtcagaatactgcgctgcaagcgggagaaaaattccggcccgtgctcttcccacgcttttaccatctttttatctttccggaacatcccctccccggagcaaggagcgtcgatcagaatcttatcaaaatactccggaaaatactcgcagagctttccaggttcctcgcttaagacgagcatattgccgattccaaagagttccagatttttcagaagtcctttggccctggaactgctgatatcattcgcaatcagtacgccttccccgtgaagctttgccccaagttcagtcgctttgccacccggagcggcacagacatccaatacccggtcccccggatggatctccaggcggtttgccggggtcatggcgcttggctcctgcaaatagtatagtcccgcaaagtagtacgggtgtctcgccggactttcctgttcgccatcataatagaaaccattttcaatccacggaaccggggtgattacaaacggacaaatccgtacaaactcctctacgctgattttagccgtattgacgcggagcccgtaataacgaggctctttataacaagccgtatatgaatcaaattcatcccccagaagggccttcattttctcttcaaatgcttttggtaattccatactttctcctttcgcatacagagtcagtatatcatacctccagcaatttctccatgctcttagtcgtttttctgtagaaaaatagtaactattcagctatacagcccagatctttatgccgggttcgttacaaaaagttgcgatccttccgcatattttaaaatccagtaaggattgatactgatctcctcttctggttcctccagatagattccaaggtgaagatgaaccgggaattgcccggtcgtcccctccttaccataaccactgtcccccatatagccaatcaggtcgcctgcttctacctcgtccccgacctccacgtctgcataggaatccaggtgggcatagtaaaagtatccgccatgagtcgaggtaatgccaagcctccagccacctttcgggagccatcctttacttgtgacggtgccgtctgtcatgctgacaatggggaaaatgcctcgttcatttttggatgccatcaagtcggttccctcgtgtccccgttttccgccgtaggtgcgttcggacatccaggaatcctcgaatgtaacagtcagatccggtttttctttccagaacatgaccggaaaatagcgcacgtccgaccagattttctcgcaggctgccatgtaggaagaataagcagggcttttttgccatggaatcgtttttctcaaaaggtcgtcctcagaaccaaacacatccccctgtcctggatgaaactgctgttccagcagatagaccccggctattctcgcaggctcttcggattttcgcattgcctggatcagatctgttgttaattcgtgacttcggaatgtatttcccttgatcagttccgggtcgagagaaaaataggcggcatcgttttggagtttaggaatcgcaattccctcaaagagcaaaagaagaaccagaataagaaattgcatatatctgccgcgtcttgccatgatttcgttctttctctttttggaatactaatatgatacagccagataggatatgacggtaatcaagcatgattcctaatcagacaacggaagtgtccaaaggcacattccggaattgggaaagttcaccaaagttcaggcctgcatggactttgagttgtcgcagccgtaaaaaatcaggcgggacatctctgtcccgccctgtcacacatgaatttttagaagaaggaagcaatttcctccacacttttacgttttggcatatccggatgaatatcaccgtagccgacactgatcacactgacaatgctctcctccagtggaatgtgaaacacgtcccgcaacttttcggcatctcgaatccccataatcagagtagaaagtccaagctcttctgcttttaaaagcaggttcatattctggagtccgcagtcataatatccccacccatttcccagctcattggttggactgccgtccatattgtagccggaacgatcttttacaatagtggttgtaataagaaccggggcgttttccgtattattccgattaaattccggcaatgcctcccttacctttgctactgcttcctcgctctgtgctacataatatcttgtgacctgagagtttttccaggatggggcaagtcctgcggcctgaatcatcttacgtatcttttctgtttccacaggttttgcctcatattttcggatgcttcttctattttccattgcctgttctaattccataaagccctcccgtcctttgatgcttctgttattttaatttagcaagtacatttttgatcatctcccagacccgtgcggtggatgcgatatccagcctctcttttacggaatgaacgtctggaatatccggtccgaaagaaacacagtcgagagttggtttcttcgcagaaagcagtccgcactccagacctgcatgtacagtggagatcactgcatcctttcctgtcacttccttgtaagcttccgccatcaaaggccggatcttcgattctttttgatacatccatgcaggatattcaccgctttcttcatgggaacccccaagtctctcagcccacatctggaagatggattttaattcctgaagctgagaattgacactgctcctgaggtaatacatcaaagcaatgctctcttcgtctgtccggatgattcccagattcagagacgtctctacaatacccggcagatcacggctgaatccctggacaccgtaaggagtcccaaccatagcaaagatcactttcctggtcgcttcttttgaaagagcgtgttctgttccttctgcgacagaaaccggaacctggaaatttggctcgtcagaagaaaactctgatttgatatcagcctccataccgtttacaatggctttcgctttttccaaatcctttgccataatcacagcttcagaagatcctgcgatgacattatccttagatcctccgtttactgatacaatctgaatatccgttccctgatccaagtgattcagaattcttccgagaatcttgttggcattgccgcgctgctcatgaatctgggagccggaatgaccaccgcgcaaccctttgaccttgattgccatgacagaaccgctcactttctcccttgttaccggaatggtgagtgtctccaggacgcctcccgcacagcccgcaagaatgattccctcctcttcgccgtcgatgttcaacaaaatattcccctgaatatgtgacagatcaagcgcattggcgcctcccataccgatctcctcatctgtggtaataataatctccagaggcggatgcggaatatcatcactgtccaaaattgcaaaggcataggcgatggcgatcccgtcgtctcctcccagtgtcgtaccttttgccttgacatatccatcctcgatataaagctccaacggatccgtctcaaaattgtggtccgatccttcttctttctcacagaccatgtccatatgtccctggatgatgaccggttcggaatgttcatatcccggcgtcccaggttttttgatgatgacgttacccgcctcatcctgtatgtattccaaatttcgatttttagcaaattctacacaccagttactgactttctcatcataaaaggtacctcttggcaccgaagaaagttcctcaaaaatctgaaatactttttttggttctaattgttccaacactgccattgccctctccctttcttttgtcaaatctgaactaattatatcacagtacttctaaaatcaccagattttccatacaatttattgagtatttttactaaaggaataatattgaaacgatatttttttaccattttcacgataatattttttgcactgatgttgttttttccaaacgaggtgtttcaaggggcaagcagcggattgctgctctggttccagactgttcttccgactctgctgccttttctgattcttgtcaatattatgcagaagacgagtctgatccgccaggtatcaaggcttgtctatcctgctcttggtccgctcttttccgtcagcacggaggggtgttttgcagtgctgactgggtttctgtgcggctatccggtgggggcaaaagtgacatcagatcttgtaagagacggcaggatttccagacaggaaggagcatatttgctctctttttgcaataatacaagtccgggatttctggcaggatttgtagtctgccagacgatccgggacccgtccctcgttcttggtaccatgatagtattctttgcggttcccatcctattcagttttctcttccgaaagatttattcccctaaaagcgtgggttggaagtcgcagcctcttatccggacgcaaaggatcgtttctcttgatctttttgatacatccattatgaatgggtttgagaccatcaccaaaatcggcggatacatcattgtcttttctgtccttctggaactgacaaaaatgcttccacttgccgacactttggccggacagattggattatcctttctcgaaataacgaacggtgtggtgatactggagacacttcctttttcatttgcggttcgatatgccttaatcatgggattgtgtacatttgggggattgtgtgcggctgcacagacaagtggaatgttgactggaagtggacttcggatcctgccatacatcatagaaaaactggctgccgcagtggcagccagtctcttggcttatttctatattcagatatcagggatgtaattactcctccatcgcctgtgcgaattctgtttctgtctcatcctggatcctgagctcttcacggtcaccgtgtaccatatcaaaggattcctggagtgaatttacaaggctgtcgtattttgtcgtataattgtccagtgcgtggccaatcagattctctacttttgccatcatatcgtccgcatagcccatcgcacccatacggagctggtttgcgtcctctgtcgcattatcgaggatctgctgtgcctgctctgtcgcggctgccacgatctcattcgcctgggcatatgcctgctgcataatctcatggtcacttacaagctcgtccgtcttcgctttggcctcctcgatcatcgagtctgcttttgtctgtgcgtctgcaatgatcgcgtccttattatcgatgatcttttgatagcgcttgatctcttccggcgtcttcatcctgagctctcttaacaactcgtcaatctgatctttatttacgataatcttcgttgtggataacggctggaacttacaatgatctatgtattcctcaatttcatcaataatctgctcaattcggctgctcatagttacactctccttctttacttcgacaaatcttgtcatttactttgttattctatcacgttcgaccaaagaactcaatctctttcgacaaaaatatggcggtttgtcttatattttttttctttcatcacatgaaatccaagatcttccatccaggaaaaatcggtacctaaagacgcctccacaatgatcagtgtattctcattcacaagaccggaatgcttcagaaaatcgaatactccacgctctgctccgatatgatacggaggatccatgaagatgatatcaaaggaatcctctccttccagttttctgagggcactaagaacgtccatcctcattagaacagccctttcttccagtctggtgtgacgtagattctgcttgatacaatctgctgctttcggatgattctctacgaaatacgcgatatctgcgcctctgcttaatgcttcgatcccgattgctccgcttccactaaacaaatccagaaaccgacagtcagcgagatctgtagatatcatgttaaacaatgtctccttaatccggtcggtcgtcggacgggtgtccattccctctattgatttcaactgtaatctttttgcgcttcctgcaattacccgcatggttttatcctttcttccaccgctttcggtagtattgatttcatttctgttccttattatatcggatagagcctttttctgtcaaatcaggaacggtaagatcttgagtattattctggtctgtgatacactctttgtaaaaagggaggaatgaccaatgaaatattttattgcatctgatatacatggttccgcttattattgtaaaaaaatgctggaagcctgggaaaaggaagaggcggaccgtatcgttttcttaggagacattctttaccacggaccgagaaatccactgccggaagcttacaatccaaaagaagttgcggctatgctcaatccccttgcagatcgcattttctgtgtgagaggaaactgtgacagtgaggtggatcagatggtgcttgatttcccgattctggcagaatactgtcttatcgcggaaaatgggcacactgtttttatcacccacggccaccattacaatctggactcacagccgcttcttcaaaaaggagacgtcctgctccacggacacacacatgttccggcctgtacttctaccgagacgttcatctatctgaatccgggttctgtctctcttccaaaagaagacagtcatcatagctatatgattctggagaatggtatgttccagtggaagaccttgaacggggaggtctacaacacttatacgattgaaaaaagaatcctgtaaaagaggattcttttttgtaattattgttctttcattacaatgtctatcttctgtccggcaaaacggatgccagcctggtctaatgcaagctttgtccgttccataatatcagcccgggcgttccagaactcgtcggatttcaaccagaggcgcacacaaagggccacatagctttccgctaaatcatctacaaagacggtgtgctccttctctttgatgacccggtcctcctgttccattacggaccggatgatctgctctgtttttttcaaatcctcatcatagccgatccgtacatagaagtccagacgacgcagatccatggctgtgacatttgtcagactgttgttggaaagatttccgtttggaatcacaatggtcttattatccacagtggaaagtttcgtgtagaagatctggatctcctttaccgttccttccaggttgtccgagtgttcgataatatagtctcccacagaaaaaggcttcaaaagaaggatcaatacccctccggcaaaatttgagagactcccctggagggcaagaccgattgccacaccaccggaagcaagcaaagccgcgactgtcgaggtatcgactccgaagcggacaatgatggaaaggatcaagattgcataaagccccgttttcaggcaagaatctacgaactgctccacgcccttatcggcggctgatcgctcgatagaggcccgcaccagctttctcacccagttgatgagaattcttccgatcagaaagaaaatcagagcgaacacaacgcctactccgaagttgatcgctttcggcaggttctcatggaagaaatcgacggcaaaactggtctgcgtcgccacttcctgctgaatattttccgtgactgattccgccgtattgtctgtcaaaagtgtgtaatacatccttatctcccttcttagcaatcaccggaaagtgccagaaacgcagccaagcttcccctttgaccgtgggatgcccggtgcgaaaacagcagatccgaattgcagttggtacaaatatttgtcaaagctatatgctctggaagaatcccggcacgggtaaagaccacttcatttgctttccagagattgagctgatatttaccatccggcttttcatagaagatctccggccagagacagggcggaaatacctcccggaatgtgtcaatgacctcgcttcctacctcgtagcaggactggcagatggacggtccgatacaggccaggatatcctccgggcggcttttgtatacttccgccatcttccgcaccgtcttttctccgataccggcaaccgttccacgccatcccgaatgggaaagcccgatgactcttcgcaccggatctacaagaaagagaggtacgcagtctgcgtaaaaggtaacaaggcaaagtcccggcacatccgtaatcaatccgtcgatatcgtgataatctgcagaacaggtgatacccttgccccggtctgcctccgtaacgatacgaatatgatccgtatgagtctgtctggaaaaaaccatatcggaagtacggacgccgatagcctccccgaaacgggcaaaattttccatgacggccgcttcctcatcgccccttgagaagcttaaattcatgctctcatagattccggtactcactccgcccatacgggtggagaaaccatgcttgaccagaccgcagctttccagaagcggaaatgacaaatacggtacaccgtttcttccggtccggcagacaatgtcttcctgattgtttgttctcttccattcgttcataccctgcacctcttgattcgtgaactttgtttttttcctatttcatcatccctgatattcaaatgcatcctctaaatgggtgatcttttctccaaggatggcaatcacgtcaaaccggattctgttctctgccagagagtgttctgtaagataaaaaagagccgcacgactgatccgctgctgcttccggcggttcaccgcctcttggggaagtcccatagagtcagttttacgatactttacctccacaaagacgatccatccgtctttggacgcgatcagatcaacttctccatggccgcaacgataattccgctccaggatccggtatcctttctcttccaggcagacagcggctctcacctccccagcctgccctttttctcttttattcatacgttccccatcacacaaaatgtctaagaaacgactgacggtggatcgggcttggtccgtatgcctggattgcttccatatgctctctcgatccgtaacccttatgggaggcaaacccgtattccggcagtatcctgtcgtactcttccatcagacgatcccttgttaccttggcaataatgctggcgcaggcaatagaaagacttttagcatcccctttgataatcggcacctgtggaaccggcacacccggaatggtaacggcatcatttaagagcagatccggagacggggaaagttttcggatggcctcgcgcatggcctcatacgtcgcctggagaatattgatttcatcgattctctgtggactcgccattcccacacccacgcttaccgctttctccatgatttcatcgtagagctgttcccgccgttttgcggaaagtttttttgaatcgtttgcatagagaatccggcagtcctttgggagaatcacagccgccgctaccactgggccggcaagaggccctcttcccacctcgtcgataccacaaatccggtcataagacctgtatttcttctcgtaggtacacatcccctccaggcggagcagttcctgttcctttgccagttcctgtttccggtaggatatcaaaagcttctgtacgccagtcctcttatcctgttcatataatgcatagagcgctctgcgctcatcgccagaagcacgttccaactcttctttgatctccctgattgttttactcatgtacgacaaaccccatttcatcaaacggataaatccgaatccaagctcttccgatcagatcctctcgccttaatacgcctacgctcggatctctgctgtccgaactgtgattgcggttatccccaaggacaaagtactcgtccgtccccagttcgatcggctcagaggcaatcccggcgtcttccatggcttcagctccatagtcctctcccaaaatttctccgtcaatataaacctccccgtttttaacctgcactgtctcccccggaagcccgatgatccgcttaatataatatgtattttcttcatatttgtatggaaatacaataatctcatagcgcttcggatcccggaaacgataagacagtttatctacgatcagattgttgccatcctggagagtgggctccatggactgaccatccaccacagtccggacaccgacaaatgtaacgatcaaccaggagaggatcaggacgatcccgatatagagaatccagtccagcacctccctggccgttgattttgacttcccctgctcttcaagttcctcttgcctcatgtatttctccccttatctgtaatcttccgggaattccagtgtcagtcttcccagtttcccgccccggaaatcatccaggaacagcgcggctgtcttttccagatcaagttctccaccctttgtcagacagtgctttttctccgcgatctcgcgcagaacttcatatggatcctcgcttcccgcaatatcataagtgtgctttacctgatccggagcactctttgaaagggaacggatcagctcggcagcaagttccatggtattcaagatttcatccttgatcgatccaataaaagcgagcttctttcctacttcctgatcctcaaacttcggccataaaattcccggtgtatccagaagctccacctgcttattcagacggatccactgtttcccttttgtcactccaggcttattgccggtcttggcacatgcctttcctgcaagggaattaataaaagtcgattttccgacattcggaatcccaacgaccatagctctaaccggacggtttaagatccctctctttctgtccctgtcaatcttctccctacaagcctcctgaatcaccttgttgatagatttgattccggctccactgcgggaattgacccgcacaacggaaaatcctttttccttaaaatactgctcccacttttcgttccatctctctgaggcaaggtctgacttgttcagaaggatgagtcttgctttctgtcctccgagctcatcgatgtccggattccggctgctgaccggaattcttgcgtccacaagctcaatgatgaggtcaatcagtttgatattttcctgcatcattctctttgctttggtcatatgacctgggtaccattgaaagtgcataggtgcctcctttttatataaatccaaaatttccttttgtcgacaagacgaaccaggcttttccctcgatctcggaacgctttacattaccgatatccgccatccggctgtcctcgctgttcttccggttatccccaagaacaaaatattcgtcgccgcccaggtcaatctcctccgcggcggttcccgcatcctcgatggcagtcgtctcatagtcctcttccaaaatcttcccgtcaatatagattttcccatctttgatctgcacagtttcccctggaagcccgataatccgcttgatataggaacgggcattttcatttccgtttggcttgaacacgataatatcgccccgttttggtttgcttgcatcgtaaatcatccgattgactaacacgatatcatcgtttaaaacggcggggcgcatggaatcaccggagtttctgacctgccgtccgaaataaaagacagtaacaaacgccagaagacagacaagaagaatcttaaaaacccagatcccgataattcggatcatatcatagtcgatctgcttttttacttttccaaactgtaatctctttttcatgcaatatacctgtttctttaacacaaaaggggcaatcatacatcaatgtaccttgccccttcccttgtcttatttaactaattctttgaccttagctctcttacctacacggtttcttaagtagttgagtttcgctcttctgactttacctcttcttactacttcgactttctctacattcggagagtgaagcggccatgtcttttcaacgcccacaccgttggaaaactttctgactgtgaaagtctctcttgtgcttcctccctgtttctttaaaacagttccttcaaatacctggatcctttcgcggttcccttctttgattttaccgtatacttttacggtatctcctacgttaaactgtggtacattttctttgagctgttcagcttcaatctttctaatgatgtcgttcattgtgtgacctccttgattcttttgacgttcttaatacgattctgtgtatcagaggaccatctcttttcttctcacaacagttccaagtgtatcataaagattctaggattgcaagttgttttttctatattcttcgagaaatttctgctctttttcggtaagttcggctttttccagcaaatccggccggttcctggcagttcggatgatggactgttctcttctccacttttcaatgttcgcgtggtgaccggataaaaggatcggcggcacctgcttatcgtgccagatttccggccgggaatactgcgggtattccagcagatgatcctgaaaactttcgaactcggctgatacatcgttgtgaagtactcccggaactaatcttgcgatggcatccaccatcaccatagcggcaagctctcctccagtcagcacatagtctccaatagagacataatctgtcacaatctcctccagcacccgttcgtcaataccttcataatggccgcagagcagaattaactcttcttcttgtgcgaattcttccgctatattttggttaaaggtacgtccctgaggcgaaagatagacaagccttggcttcttcccttcaagcccctctttggtctcctggcagaccgccttataacattgataaaccggctccgcctgcatcagcatacctgctccaccgccgtacgggtaatcgtccacactttgatgtttattaaatgcataatctctgatattcacagcctgtatggaaaggagccccttttgttcggcacgtccgatgatactggttcgtaacccctgttccaccatttctggaaataatgtcataatatgaaacttcatggatgttccctttcgtactattggatcagacctttcatcagatggatcgtcatctgtctggcttctggatccacgtgtaaaatacagtcctgaattgccggaatgaggacttccccgtgttcatccgagtcaatgatatacacgtcgttagctccggtctctatcacgtcctgaagctgcccgaagaaggcgccgtcctctgtaaaaacttccatcccgatcaagtctgcaatataatattcatctgcctcaagcggcaccgcatgttccctttcaacaaacagcggacgccccttataacgttcaatatcatttatatgatcgattcccttgaatttcaaaattaccacctgtttaaagaagcggacattctgaatttccaatggaatctgttcttttccagtatccagaaggacctcttttaaatccagaaaccgttctttgtcatctgtagttggaaacactttcacctcaccacggatgccatgcgtactggagatcactcccacctgcaaaaacttttccatcgtattctccttttcataaaaatgaagaacagccccgcacatgccctgcatggcagcctgttctttctttttgcagtccgcagacatcactctttaagtgatatctacgactacctttttgtcttcttttgcggcggcggcttttacgacagagcgaattgcctttgcgatgcgtccctgcttaccgatcaccttgcccatatcgccttctgccacatgaacttcaatgaccgtcgtcttgccttccgtcttttctgtaactacaacctgatcaggctcgtcaactaaagccttcgtaattacttctactaattctttcatatgcaggcacctccgacgtctggattatttttcgataccagctgctttgaaaatcttgcttacaacttctgtcggctgtgctccgttgtttaaccatttttttgctgcttcttcatcaactttgaattcgcttggatcttttgtcggatcgtaagtaccgatttcctcgatgaattttccgtctcttggagaacgggaatcagctacgatgattctatagaaaggagcctttttctgtcccattcttcttaatctgatctttactgccatttgtttcacctccatttattgttctttctttatgttaaaaaggtaatttaaattttccctttttaccacctttgccgcccatcatcccgggcatctgtttcatcatctttttcatctgttcaaactgcttgcagagcttgttgacctccgaaatatccacgcctgctccctttgcgatacggtgctttcgtgatggattcaggatatccggatttctccgctccttaacggtcatagaatagatgatcgcttccatccgttccatcttgcgctgtgcgtcatcagagtcaatatccggtgtcttacccatcttgcccatcataccgccgatgcccggaagcataccaaggatatttccaagaccacccatcttacgcatctgcttcatagattcaagataatcctcaaaatcaaactgggcttttcgaagcttctgggacatctcctttgccttgtcctcatcgatatctgcctccgccttctcgatcaaggtgaggatatctcccattcccagaatgcgcgacgccattctgtccggataaaactgttccaaatctgaaagcttctcgcccataccggcatacagaatcggacatcctgtcactgccttaatggaaagagcggcaccgcctctggtgtcaccatcaagcttcgtcacaatgacaccatctataccaatcttatcgttaaattccttcgctacgttaaccgcatcctgacctgtcatcgcatccaccacgaggatggtctgatgtacggtcacagcctccttgatctcccggagctcctccatcatgccttcgtcaatgtggagacgtcctgctgtatcgaggatgacgatgttgttgccgttctttgccgcatgttccagggctgccttggcaatattcgccggcttatgcttatcacccatggtaaacacatccacaccctgcttttctccgttaatctggagctgctgtatcgctgccggccgataaacgtcacaggcaactaaaagcggctttttcccctttaacttgaactttccggcgagctttgccgtggtagtcgtcttaccggctccctgcaaacctgccatcataatgacagtcgtggctttcccaggctccagcctgatctccgttgtctcagaccccatcaaagcaacaagctcctcgttcacgatcttgattaccatctgtcccggattcagtccgttcattacgtcctggcctaccgcacgctcctggacattcttaatgaaactctttacgaccttaaagtttacgtcggcttccagaagcgccatcttcacttctctgagagccgtcttgacatcatcctccgtaagccggcccttactccgcagattccggaatacattctgaagtttctcggttaaactgtcaaatgccattctataactcctctatgatttcatctgaaatctgccggatctcgtggatcagagtttctttctccttctcctgccaggtatccagcagacgatcaatttgatgtactttttctttgattgcaagaaacttctgaatcagggaaagcttttcttcgtatccctccaacgtcttttcgcagcgccggatcgtatcgtgaaccccctgcctgctgatcccccgctctttcgcgatttcgccaagagagagatcttccagaataaactgttcgtatatttctttctgattgtctgtcagcagttcaccgtaaaaatcatataaaagagactgcattacgatttcattcatgtttctcacctgtgatatcatactataaacaaaagaaggtgtcaaggcttttttcttgacacagtaatttttttggacctctataaacataatacaattagtcttaggattgacttcctttttacaaaagacaccaatacagatgttttttagtgcagtatttttgcagataatcaaaaattggatatgaaatttatattaaattataagatacgtaaggaaattgcgagaaaattacttgtaaactttcttttttggaactatactataaatcaaatttaaaaataccggaaaggagtgttatttatgagattaaaagacaaaattgctgttgtaactgcatctaccagagggattggtgctgctattgcggaaacatttgcccgggaaggggccaaagtatatttagctgcccgcagcgccgaacgtgctaaaattatgattgaccggctgacaaaagagggatgctttgtttcatttgtatataatgatgcattgaaacaggagacttataaaagcatgatcgaagaaattgtagaaaaagaaggtagattggacatccttgttaataatttcggcacgtccaatgcagacaaagatctggacattcagtctacggaatatgctgaattcctgaaaaccctggatttaaatatcggaagtgtctttctcgcctcgcaggcagtgattccgcatatggcgaaaaacggaggtggaagcatcatcaatatctcttctgtaggcggttctgttccggatatttcccagatcggatatggtaccagcaaggccgctatcaattatcttacgaaattaattgccacgcagacggcccgggacaatatccgctgtaacgcggttctcccaggtatgaccgcaaccgatgccgtgatgcagaatttgactcagaatttccaggatttctttctgaaacacactcctatcaagcggatgggaaccccagataacatcgctcaggctgttttatattttgcaagcgacgagtcttcttttacaaccgggcagatcatggaagtttccggaggttttggtatgccaactccaatttttggagatatgatagaactaaaaaacagaaggtaggaaagagtccctgagactctattgtgatcttagcggtggttctcccttaatctttttggatcgtgagaggatcaccgctttccttcactataatgttggatttagcagcttctcgatattcagaagtcccctcccctgaatattgggatcctttcccatatcatcagcactcatcaaaagtctgagctttacctctacatttttcatatccggatatttgcttaataaaagcgccacggctccggaaactaccggagctgacatggatgttccgcttttgacggaataagctttctggtttttcttctgggagaatccattacacgaacggatataggatccaggtgctaccagatccggcttgcagacacattcggaggtcggtcccctgccggagtagttcgtccctacttttccgtaccggtctttttgattcccatcatcggacgcgcccacagtaatcacttttttactgataccgggaatcgtgacagttccgcttctagggccgaagttacctgctgctgtcacgaccaccaatccttcatcccaaagccggtccacccaacgcatcagttccatctcttcttcatccccttgatgaggcaaggttccgatggagatattgacaatccgaatctgccatttatccctgtttcttaagatcgctttgatgccctcaatgagaaaccggattttcccttctcctttttgatccagcaccttgacagctacgatctgggaggcaggcgcaattcccgcatagagtccggaagataatcctccggatcctgcaatgatgccagccacatgggtgccgtgagaattatcgtcatacatacgcttcttcccataaagcatatcgccaaaggccacgatcctccccttcagatccgggtgcggggaaataccggtatccaggaccgctgtcgtaactccgtgtccatcgatatggccaaacaagatatcattacaaaaataatgaacggtttccttgacccgtctcactgacaaaactccttttctttcagcctattcagaaaaaagcctcattgtgcgctccttcttctttacatttttttctataaatccaggaaacacttacaagccctgctacatagtataacattgtaaataacaaaaatggaggcaacaacatgagtgacttaagtgcaacaaactgtggatgtggatgtgaatcttcttctggattcggaggcaattcctgcctgtggattatccttctgctctgctgctgcggcggctgcggaggaaacggaagaagcggttttggcggcggatgtgactgcctgtggatcatccttctgctctgctgctgcggcggattcggaaacggattcaacgacaacggctgctgctaaatccaactgacgatggaaggaggcggggtaaaacatcccgcctccttctgatccgatcacctttcttagtcaaatgtgaccacatcgtggaccggtttctttgctgggatcatctcttccaggtagagcaccggtcctttttctttgtattgcttcatatattcatagcggaacgaaacggttacgaacacccagtcccggttctggtatggaaattcttccttatacctgcaaagataaccaaggaatgtgatatcctcctcacagcaggtcatcacaaaacgccccggcacaaaaagtccagagcccaactttcttccccggtacacctgtgccagaaatttgagctttttatttttataatgttccggatgctccatagcatccaggtaccagatcccataatcaatctcgtcgatctcgatcaccggagctttcagatcaaatggaagatcctcctcggttgtttctatcggttccccactctcatcttcaaagacgatctgagccctcgggttcatcactttgatgctcctgcggatctttgcccggtctgtatgctccattgtccgattgacaatcaccagatccgaagaaagcaacggagcaagaaacagatttcgcatgttgagaagatacatttcagcagtttgggcatctactgtggagagtaccgctccgatcccccatcccggcggcaacttcatctccagcagccggtttacatcccaggttccgttccactcaatcattacgtgatccgggcggtaattcagttccagcccttccaggaagaattcattgatcttttcctcctcgtcaaccacatatttgataattccatttttcttcagccaagcctcatcgtactcttcatccccctcctcgcagacgatgagaagggtctgattgtagtcaagaaagtccgggctgtgcagtgcttcccgaatcagtgtcgtctttccactatccagaaatcctgtaaaaagttctactattgtttccatcttgttgctcctgtctatacatgcagagtctgctgaattttatcggtgtgaatatccgttccgatgacgcacaccttaccggtgtaatccggttttgcgtcacggatttcatattctcccggcacatagtcaaattccatccatgttccatccattccttcaacaattcccttggcacgcagaacagtgccataggtatgttcctctgtcagtgcgtccaggaaccgctcaatctctgttctctcatatttttcagccgtctcagtgccccagcttgtgaatatctcatccgcatggtgatgtccctcatggtcatggtgatgtccatgacagcatccgtcttcatgatgactgtgatggcaacactcctcatcgtgatgatgcccgtgatggcagcatccgtctccatgatggtaatgctcctggtgcagacatgctttcttgagaagatccgttggcttagacgtctgctcaacagccttacggattacttcgccgtccagcttgtcccatggggtggtaatgatggacgcatccggattctcctcccggatcaggtgaaccgcctctttgagtttctcgtccgtcatggattgggtacggctcagtacgattgtagcagcatgttcaatttggttgctgtaaaactctccaaagtttctcagatagctctttactttcttgccatctgcaactgtaatacaactgttcagttcgatcccgcaatcttcctccacatttctgactgcaccagccacatcggagagtttacccacgccggatggctcgatgagaatccggtccggatgatactgctccacgacttgttttagtgcttcactgaaatcaccaacaagggtgcaacagatacatccggagttcatctccgtaatctcaattccagcatcttttaagaatccgccgtcgattccaatctcgccgaattcattctcgatcagtacgatctgttccttctgaaatacgtccgttaccagacgtttaataaatgtggtttttcctgctcccaggaaaccggatataatatctacttttgtcataatgattccttctttcttttttcatcgtcttttatcataacagtttttttcttcttttgaaagtattcctgagaaaagtttctcctccaaaagagaaaggaccggaaatccggtccccaatgtgatagtatgtttttagaaattctcttagttactgtctgattatcggtccttctgacgtttctgtgctttctcttcatcctctttattgatacgggtagcaagagtctcctcctgagtgttgctcttatgctggagcatacattcttcgtccagctcatagacggtatttccatccagaatcagctttcttggcatgtctcattctcctttttccttttacttccagtatatgatacccgcatattttcggttttatacacatatatatttacaacgccggatcagataggagatgtataacatgaagaagaaaactccgtttcccatgacaccttttgatatgctcgtagtaccggaacagctccatatgatgaagctgtttcttccctatctgccttccggcacccaaaagatgctggcactttggatcaaatgtcaggaacttacaaatacgattgcctatttccgggactatccccgcatcggcatgggagaatgtacctccccaaagcaggtcaacgccatggaacttttcgaggagcttcgtccttatatgaaagaggacgaggctgatcagatcgacatggcgctttccgccatgagtatgatggaaatgatgcaatcgccagaatcctcatccgggcatccggaaccctccgattttctgaaatccatgatgccttccggtaccggagagatgtttgatctttacagccagatatttgaaaaaggaggcgacgccgaacatgaatccgaaggagaaccaatgggaccaatggatgaacaatccggttttccagaatctggatcccctgaaacaggaactgatgaggacggcatttgaaaggacacgtggaaaaacagggcgcaatcttgcccctgttatgatgtctttgattacacaggcaaatcagaaaggcatccggttttctgaggaagaaatgactttgattcttcagtttttaaaggaagggaaaagtcaggaagaacaagccagaatcgatcagatggttgcctttgtcaatgcagcctggaaaaaacggatgtaaacagaatcagatatgaggcagtctttgccgcttaaagcggcagggacgccttgctttcttgtgtttctaaaatccttcttcttttcgcatcaaccggttttctctgcgcttaagtgctccctcccactctgccttttcattttccgtctctatgagaagtcccggtacttccttgggcctgtccgtctcatctaaagccacaacagtgaaatacgcccggttgatgggctttcggataccagttaagtcttccacataagtgtctacccggatctccatagaagaccatccggcgtaggtcatcttcgcacggatcacgaccatatcgtcctggtaggctcctcggataaaacggaggttatccacagaagccgtcgtaatattgctcatacagtgcctttttgcgacaatccctgcggcttcatcaatccactgcatcagtactcccccaaaaagcctccccgccgggtttaaatgggtcggtcttacgatatgaacggtctctaccatggagtcttctacacgttttaccttactctctttcatcttttaacctcttttgactttcttttttctgctgtttattatatcatggtactacaaaagaaaaaaggagtaaaatcgatgcgaaatatcagactgacaatagaatacgacggttcccgttttcaaggctggcagcggcttggagccggggaaagcactgccaatacgatttccgggaaactctgcgaagtattatcccgcatgaccggccagttcccggagcttttctgtgcatccaggacagagacgggagtacatgcttacgctcagacggtgaatttccatacggactgcacacttcatacgacggatatccgtcactacctgaaccgatatcttccatctgacatcgcggttctggacgttcaggaagtgccggagcgatttcatgcatcgttaaatgccaaaaggaggacttatcgttaccgtctttccattgcagacgtaccagatgtatttgaacgtaaatatgtctatcatctgtttaaaaaaccagatgtggaaatgatgcgtcaagcggcccgacttttgatcggaagacatgatttccagcgtttttcctcttccaaaaagaaaaaaggcggaatcaaagaagtttttgatattgatatctatcagggcggtgaagagctggagattaccatctgtgccaacgatttcctgcacaatatggcaagaatcatcgtttccacacttctggatgtgggacaggggatgcgtcccatagaggatatcccgcgtattttcagcggagaggagactgcctctgatccgattgatccgaaaggactgttctttcaaggggctgaatatccgcaggaataaaagggaaaagcacggcggaaagaattgcatgattccacacaccgtgctttcttttatgctttcatatattccagtagtctctcgtactcttctttcatctgaacgtatccatgttcatagaacgatgtcagcctgtcatagttcttctccaacctggaaattgctttgatctttggacgaagtacaaagacttcccccctcttctcaagctcttcgatctgttccatctgcttattgtagataaacggacgtcttaagattgtgcggaccagattcggatatttcttataggcggcccggtagattttcgtctcacccatggatggtttctttttgcggtatccttcgtttctcgtcagaatgacgatgactttgcgtttgcctttttgcaatgctctccggatcggaaccgaatccgcaagaccgccatccagatacggagtccctccgatccgaacaatcggagccgcaagcggcatactgctggaggcacgacagatctttaacagccggtctttttcctgtttttcctccagatattccgctcttccggtcacacaatttgtcaccacctgctcacagcagatcttcgactgaaaataagtttcaaaatcaaacgggatcagttcgtttggataccggtcgaaaatcatgtccatatccatcatacttttttcctttaccatcttgcgcaatcccagataataattatattctttttctttgtgtatcatgcatttttttgtacgtccgatctgtctggacacatagtcgatagcgttgcacgctcctgcggaaacaccaatgacatcagtcgtgtaaaactctttctccatcagaaagtccagcgctccggatgtaaatacccctcttgtggcgccgccctccaaaaccagaaccgcaggaaccagcgtactgtccgggttttcatgtctgttttccatcgatttctcctcctgcttttaaaaaatcatgtgcgaaaagcctttgtcttttatagtatcagcttctttttgccaagtaaacagatatttttatctttctttagtaactatttaccatgcagcctgaatagttacttactttatggtatactgatcttgctataaaagataaggaggaaattgtctatgatcagtaaagattttcatgcatccagaagagcgctctatgcgtcggtacttaaagatgattcagtcggatttgtctttgcgggcagggaaagggaatggaaaggggatgaaatgtatccgtttatcccatatgccaatttttattatctgaccggatttacttacccggaagcagtcctgatggtggtaaaacgaaacggccatgtacgggagaccctattcattgaccatccggatgaaaaggcaaagcgttggaccggagtttcctacacaaaggaaagcgtaaaggaacaaaccggtattggaaatgtcgattatttggaacgttttgaacaagcaattccacttttcggagagccggggctcatccgtcagatttatattgacattccgggctgggagcgcccgtttgtcaagaatgaagcccgggagtttgcttcccgcctccacgattttgatccgaccattccgatctacaataccttccaggatctggcttatttccgccaggttaagacaaaggaagagatcgccttgcaccggactgcatgtgatattacggccattggtgtaaaaaacattctttcccacctgagaccggggatgcatgaatacgagatcgaggcatactttgacttttctttaaaaagccatcatgccgaccatgcgtttccgacgattgcagcctccggtatcaatgcatgctgtatgcactatgatgcgaacgaccggcagatggaagaaggagatctgattctttttgaccttggcgccagatggggcggctataatgctgacgtcagccgaaccttcccggtcagcggcagattcactgaacagcagaaagccctctatgaagtcgtattaaagggtttggaagtcgctatcgccgcttccaaaccgggacagccgaaaaacgaactccaggatcttagcaagcaggcaatggcaaaagagctgctccgtcttggcatcatccaggaaccggaagaaatcaaccggtattatttccatggttccggacattacatcggcctttacacccatgatgtaggtgatgacaacgcgcctctggaagaagacatggtctttaccttggaacctggtctttactttgatgaccttggaatcggaatccgtattgaggatacgcttctcgtaacaaaggacggctgtgaagtattaagcggcggtatcccgaaaaccgtggaagaaattgaaacttttatgcagaaatatgccgcgtccaacgaaacagcctctttgacagtgtaagcctcaaatttgttccgaatagttgaatcgtgtgcattttcacaggtcttccggggaaagaccttgcaaagggtcggcggagtgtgttaagataagcgatggttattacacgtatacaatctgaattcaagtaaaggagaatggaacgctatgatcagtacaaataatgtcacgcttcgcgttggaaagaaggcgctgtttgaagacgtaacaatcaaattcaccgaaggtaattgctatggactgatcggcgccaacggagccggaaaatcaacgtttctgaagattctttccggtcagttggagccgaccaacggggatgtggtcattactccgggagagcgcctctctttcctgcagcaggatcattttaaatatgacgaatacatggtgcttgacactgtcatcatgggaaacgcaagactatatgaaattatgaaagaaaaagaagctctctatgccaaggaagatttcaccgatgaagatggaatgaaagccagcgaactggagggagaatttgccaccatgaacggatgggaggcagagtcagatgcagccaatctgctgaacggacttggtatcgaaacagatctccactatcagtacatgaaaaatctgaccggtgctcagaaggtcaaagtgctcctggcacaggcgctgttcggtaatccggatattctgctccttgacgagccgacaaaccacctggatctggatgcgatcgcatggctggaagaattccttattaattttgagaataccgtcattgtggtctctcacgaccgttacttccttaataaggtctgcacccagatcgctgatatcgattatggaaagattcagctctatgcgggaaactatgacttctggtacgagtccagccagcttctgatccgtcagatgaaggaagcaaacaaaaagaaagaagaaaaaatcaaggaactcaaggagttcatatcccgattcagcgccaatgcttccaagtccaagcaggccacctcccgtaagaaagcgctggaaaagatccagcttgacgagatccggccatccagcagaaaatatccttatattgatttcaggccaaaccgtgaaatcggaaatgaagtcctgatggtggaaaacctgactaagacaatcgacggcgtcaaggtgctggatcacgtaagctttacgatcaatcacgatgataaggtggcttttgtgggcagcaatgagcttgcaaaaacaacactcttccgcatcctggcaggagaactggagccggatgagggaacttataaatggggcattacgacgtcccaggcatatttcccgaaggacagtggaaaagaattcgacagtaatgatacaatcaccgagtggctgactcagtactctgaggaaaaggacgtaacttatgtccgtggtttccttggacggatgctctttggaggcgacgatggtatgaaacgtgtcaacgtcctctctggaggtgagaaggtgcgttgcctgctctccaagatgatgatttcaggggcaaatgttctgattttcgatgaaccgaccaaccatctggatatggagtccatcaccgcactgaacaatggaatgatcaagttccctggagtgatcctcttctcttcccgtgaccaccagattgttcagacgacagcaaaccggatcatggagatcatgccaaacgggcagatgatcgataagatcacgacttacgatgaatacctggaaagcgatgaaatggcaagaaaacgccagacctactctaccacagcagaggaagaggaggacgattaaactttaggctcatggcacatacaaaaagctgctcttgcggggaacattctcccactggagcagcttttctatacgctaatttaccatggtttcacttcttccttatagtaagtattcccttcttccaagatctcatacccctcgtttgtcacatctacaaccgtcaccgcacagtttttatggacgccctcatcccaaaacttgcgaataggaagttctttgatatgacataggagcgaacataaggtagctccatgcgtggagataagaattgtcttgtgttctagcctgggatcttttctcaattcttctaaaaacgatcctgtcctttgtaacaattcttcaaaggactctcccccttccggcggctgatacaattccggagcatggaaaaaatgaaaaaaattcggatcccgaatctccgaaccttcccctttgcagatcaatccctcgtaaattcctagccctatttcctcaatcctgggatcgtcaagaattggtacgcttctcttgccaattaccagttctgccgtccttctggcccgtatcaggggactggtgtatgcaagatcaaacagtatatcacgaagggcttctccggtttcctttgccagaagctcaccaaatgcattgaggggaatatctgatttcccctgcagccttttttcgttattccagtccgtcactccgtgacgaatcaaatacagtcgcatgactctttcctccttttcactggaactttagtataacacgatttgatcctcgttgaaatattttatttaaaaattatcctcttgcccttttcccagaaccagtctatactacaaaagaagaaaggagtgtatctgatggaaaagatcacaagttttacgataaaccacttaaaattacttcctggggtttacgtttccagaaaggacaaggtaggaaatacgatgattaccaccttcgaccttcggatgacaaggccgaactgtgagccggtgatgaatacggccgaagtacatactctggagcacctgggagctacttttcttagaaaccacgagactttcggtaataagaccatctatttcggaccaatgggctgtcggacaggtttctatctcttgctggcaggggattatgaatcccgcgatattttaccgctgcttaaggagatgtttatgttcatggcagaatacgaagacgaaattccgggagcttctgccagagactgcggcaactacctggacatgaatcttccaatggcccgctatctggcggtaaaattcaaaaccgaagtgctcgatcagatttccgacgagcgacttgtttacccgaaataaaaaacgcactgtctataaacgtaatcgattttacgcttacagacggtgctcttttttcttttgccggatcacacgtttcagatatacgaacgtcctcttctccccctcctcagccagcatatgaagaagcttttccaatactttttttgtataaggatgtaaaaactgttccgagtttcccttctcataatattccagtgggctgcagtccgtatatttatctttctgatatgtcttggaagccgcaatgcggtccagaaacatctcatagatgtaacgatctggcatcttcattccgcaaatcccgtcttccggacgggtactgtaatccatccagtattcatagtgatgtttattacgtcctttatggtgcagccatgcagtagaacacccttctgcttcccgctgtgcattattaggactccgggtgccctgaaaataccggcatccgaccccaaattcactgggcgaatacttggacaggtcatggagaagcccttgtttatagagtccaacataaaaacaggctttcatcaccagcaatttgtgctgtgtgatggtacgaaaatgtccccagatattcattggtctacctctcttcttactgaacgatgatcaaccgaatgacggccaggataaccaaatgcaacggatagaacagataaaatactactttcatatccctgcccttttctccttggtacaggtggatgggaatcagagccaaaacagcaaacatctgactccttcccataagcagtacattgacagccgccaccgtcagatcccgcttcagattctcattataaaagcaataaaagaataagatcatcaaaagccccatggaagaatagtctacccgaaacatctcagcagccagcaaaaccatgagcaaagacaaacactggaaaaccagattatcaaaacaaagccacaaatacagcatcaacacgccaagggcaagggtgaataatacattctgtcttcccagataaaacggggtgccaaagagagccagatcaaagaaaggctccgatatcacagcgcaggcgaaaagccgaagtccatagcgtggtacgttcctcgtatacatgaatccgacagccgtagtgaaagcaaaaatcggaaaagaaatcctgccgatgatatccaaaaaccagaattgaggaaacaaaatcagccctacgtgatcgataagcatggtgatcagcccgatccatttcaactggcaggctgaaatggacagattatttctttttggtgtttgttgtttcatatgtctcccctgtaaaaaccgcaaccgaacgtgcctcaatcatcgctttcctctcctggcagatcacagactcctcccctaagaagccttcccggtcggtagtggagaagatctttctccatctctttccctttcctggtgacggcaacgcaaacgtgtgatcctcccagtgcatattgtaggcaatgtataggtcatcttctccctttcctgccccgctgtagaatacgccaagctgtctgcttgcgatctcatttggaacctgccatgcattttctccgtggtaagagatatccggcactccgcaacgtgcaagatcgatcccctggcactctgtggatggatgaagagtcttatgcgcctttctgaactgaataagctttctcacatagtctgtaagccactgctcttttgcggctctcttccagtccacccaggcagtctcattatcctgacagtaaacattattatttccattctgggaattagcaaactcatcgcccgcaaggatacatggcgtcccctgtgccatcaaaagaagaaagaaagcatttcgcatctgctgctccctgagcctgagaattcctttctttctcgtcggcccctccgcgccgcagttccaactatagttgtagtccggtccatcgtgattgttttctccattacgctcattatgtttcccgtcataagaaaccaggtcattgagcgtaaagccggtatgatctgtgatcatatggtactggtaatcgttttggcttagatgcttcagatgccagatcacactctcaaccattccttcatcaccttttaaaaaccggcgcatcacgttctgaaaatcctcatttttgacgatgagcttcatgtgcttcagataatcgtcactttggatcacttcaagtggtacggtatatggatttacgataaaaccatctacatggtattcctgccgatagtaccggagacattcgatcatcttttgctttggcatctcatcaaaaaatggtaaatgcaacacgacttcaatccctgccttgtgacaggaatacaccatttcctttagctctcttactgggttccctttagcataacgcttctttggagcaaagcagtaggcctccccatacccccagtaattggaggcaaagcggatccgatcctcaaactcgtaaacaggcatacattgaatctggttaattccaagctcctgaaaataaggaattttctcaatgatccctgcaaaagttcccttatttttaaccctggaactctgtcccttcgtaaagccacggacatgaagactgtaagcaatgacgtcttcatccggaagatccaatggccggtcatgctcccattcaaaatccggagtacatagaaccgctctcctgcattccacctcagtcccatcctgttctgtttccatatattttcgaataccatgagcataaggatcaacatatggagctccgtcaatctcatagatatattcgtcaccatcccgaatgtcggtctgaattccagaagaacgaatatctccgtacaggatgtcttcttccatctggatcacccggtacggctttgtatgattcccccggtagatacaaagtttacaactttttcccttaggaaccgctacagaaaaagataccccctcttccgtccataatactcctgccggtaccggccttttttcttcatgtttcattattttctcaggtcctttccggctgacatctactgccaaccatctactccatacatgcccacattactgcggtcaataaagagcacttcttccagtgtctctttttcatatctttccccattcataatctgtaatgcgacagtgactgcggattttccgatattaattggagactgtgccgcgatccccacaacaaggctgccatccttggcaagctcctgtttgagtttgggagaaccatccacgctgtagatcatcatctcgcttctgcctgcctcttcgatggcctccagcgcacctagagcaatctgatcgttgccgcacatgacggctgtaatgtgatcctgctctttgaggatccgggccatctgcgttttggcctcgtctttcttcccccctgtctcagatctttccaccacttcgaacccttttccggcgatcgtctcctcaaaaccattgatccggtcgataatggaattctgcgttgtacattccaaaattacaacctggcctccatcaggggcagcctcaataagcttttctccacagattacgccggcattgatattatctgatcccacataagcgtccacttcctcccgatcctgtacctgagtgtccaggttgatgatctcgatatccgcctctttgagctcggtcagtgccggagcgatcttctcccagtccaccggacacaagaaaatagcctggattccgtcggcaatcatgtcccggatctgctggatctgcgccgtagaatctcccttcgggtctctggatatcagggtactgcctgattcctcgatggcctcccggatggatgcttccaacgtctcgtaatatggattctccatggaaatacaggaaaacccgaatttatatgatacaatctcttcttcctcttcttcctcttgcggcaccggattatcctccggagtacctcccgccggctttgcacaggatatcagccccatactgagaatcagcagtagcgccgcgatgcctgcagcccatcttttgagtttcatactgttttcctcccgatgtgatactaatctatcttattttaactttttctcgcatagaatgtcaatagttcttgagtttcccttgctttttgtcactgtctctgatacagtaaatttatcaatacaaaggagacaaggaagtatggaagatcaaaatctaactgtcactcttacgctggataacgatgaggagctggagtgtgatgtgcttacaattttttctgctggcacacacgaatatattgcccttctgccactggatgaaaatggagaagccaatgaaagcggagatgttttcatctatcgttacgaggagattgacggtgagccaaatctttccaacatcgaggaggatgaggaatacgatgctgccgccgatgctttcgatgagtggctggacgagcaggagtttaacgagcttctggatgaggacgaggacgagtaaaaagttcctggacaaaacgggatggatgaacttctttcccgtttttttctttgatataacagatcgtgagttcctctttagcacgtgtcatggctacataaaagagtcttctctcttcttcgatctcttggtctgccatcgctttccggtggggaactgttccttccagcgcctcaatgatataaacacagcggtactccagccccttagccccatgcatcgtcagaaatgcggcctttccttttgtaaacttctcttctttttccatctgccgaagcttatccgtgtagatctgggaaaaatccagccattccttcatagtctttcgtcttttcatgctttgagccagctcatctacgatctccagaaagtccgtctcttcagtctgcagcttgtttatttgttctttcaagaaatcctgatacccgacttttttgagcagatactgaaatgccgcataaggtgccatcgatgagatttccttcatatcttgctcccactcgtcaatcctgtccagcatccagtctttgtcacaataaaacctcctaagatcttcaaagtccgtccgctctttctcaagagcgctccggccaatataccggtttggcctgttcataatccgtaagaaatcactccggctgcgttctcccatggcaatgcggaaataggctttgacatcctcggcaataaagtgctcaaaaagatgaaatgccttttcctttataaaaaaggggatacctcggttcaaaaatgccgttatcgtaatggacgcatcctgcaccgttcggaaaattatcgcgatttcttccggaggtatcccttcccttagctttttgttcacctctgccgctacataatctgcttcctgctccatgtcttttacttcctgaacatgaaccggacgaccctgaccgtgtaccgcttgcagctctttagagaaacgctgtcggtttttctggatcaccctgtcagacgcctcaacaatgaattgactacttcgataatttatggataatctcacgatggaactccccggaaaatcctcctgaaaccgacgcataatccccggcgtagcgcctcgaaatccatagacagactgatcgtcatctcctactacaaagagatttctcttcttccccgcaagtagttttacgatctcatactggatccggctgctgtcctggaattcgtcaatcaatatgtaagaatatcgttcctgccattttttcagaatatccggccgcctgcagaacaactgatagcaaaggagaagcatatcatcaaaatcgattcttccggcctcttttttacgcttttcataggcatgataaagctgacggtcctccggatcatcagagatccctgcaaatccgccgttattcttcaccttaccgatcatcaaaaggacatctttttctgccggacgacgatggttttctctttccacatccgctacagatgcctcgatcattgtcttttgctcttcttctgtcaggatctgatccggcgtcatatggtaaatctggcgaagcatcccgtaatagatcccatgaaatgtcccgaatgtcaccgggtaatttcttgtacccatccgctcccagaatctctctttcatctccttgaccgcatatttggtaaaagtgatgacaagaatctcctcaggccggatctgcaaattccgaatcatccattccagacgtcccgtgatgacagccgtctttccggatcccggtcctgccaataccatacagggtccgtcccggtggcagacagcctttttttgtgcttcattaaaattggaaagcgggggtttttctcccccgccgtactgcttttccatagactatttctccaataatgcgatacccttacggatgcgatcaagagattcttcttttccgagcacttccatgatttccgtggcgccacccggcgtattctgcttgccggaaaccgctgtcctgaccggccacatgacatagccgtttttgtatcctttttcagaaacatactctttcaaagtcgcaaaaagtgcgtcgttgctgtaatcctcctgcttctccagaatcggcagcagatcttttaacacttccagtgaggtttcctcgtttgtcttcatttttttatgaacatacatggacggatcatactccggaagcgtttcaaaaaagtcaatctgccccgggatatccgggaaaacttcaattcttgtcttcacaagagccgcaatttttttcagatcgtaatcctttgtaatggcctcctgaatgtatggaagcgccatctcatagaaggtatcaaactccatcgctttcatatactcgctgttcatccatttgagtttctgtatgtcaaataccgcaggagatttgctcatatgatggaagtcgaacactttcaccagttcctcaaggctgaaaatctcctgattatcctgtgggcaccatcccagaagagctacatagttgactactgcctccgagataaatccctgctcaattaaatcttcataggaagaatgaccacagcgcttactgagtttcttgtggttctcatctgtaatgagaggacagtgtacatagaccggtggctcccagccgaatgcctcatagaggcgattgtacttcggcgcggaagacagatattcatttcctctgaccacatgggtaatattcatcaaatgatcgtcaatcacattggcaaaattgtaggttggataaccgtcagacttgatcagaatcatatcgtcaagctccgcgttattgaccgtgatatctccgtaaatctcatcgtggaacgtcgtagttccttcggtaggcatattaatgcggatcacatatggcttcccttctgcaagattcgcctcaacttcctctttgctaagggacaggcaatgcttgtcgtagacacggatctctgttccgctttcggaaacagtggacttcaggctgtccagacgttccttgtcacagaaacagtaataagcgtctccctgctcgatgagctgctttgcatacttcaagtaaaggccgctctcatttctctcgctttgtacatacggaccataacccccgtctttatccggaccctcatcgtggataagtcctgtcttctctaatgtccggtaaatgatctccagcgccccatccatgaaacgctcctgatcggtatcctcgattctcagcataaagtctccgccctcatgctttgcaatcagataggcgtaaagcgccgtacgaagattgccgacatgcattctgcctgtcggacttggcgcaaatctcgttcttactttgctcataatatttctcctgctttcctttttattttttatctttgcctgttatattcaccatatcgatgatggcaagactgaccacaactaaaaacatcatcccgtaaactgcgtatccctgaagcttctcagaatcagacagaaatacaataaggaaaaagatcaccatgacaatatccacgataagcatcgggataccaagctttcttcccaccttcttcggatcaagggttttctttactttatccgggagtgaacggtaacctggcaccatattcagtgcttttccactaatcaataaaatactcagaacggtcatcagtgcaactacgacaatacttccaatcatctcttttcttcctttcctccatcctgccgggtataacgaagggaatcctgcttccagtctcctcttcttataaccttaaacaaagtatccatcaaaaagattgccagcgcaatcgcccctgcaatctcaatggtctgtgtcagatagtaacctgtcatgacccggtcattctgtaacattgaattcataatctggtaaattccatttcccggcactgtcggcaaaattccaccaatcagaaacatcgtgacaggagctttcagaatccttgcgaatatatgggatataaggcctgccgccaaagcagaccagaatgaagcaatcactggattccatccagtctccacacagataatataaataaaccccgatgccgcaccggcaattccggcccagagcagatacttcctcggtgaattaatcaggacggagaaggaaaagacagcgatgaaaaacccaatcgtcttgattccgatatctatcataagatccctcctgtcattccatttccgaaaatcgcaaatgcgacgccgactccaagggcaatcgctgctgccttcaaaaatgcctccaggattctggcacatccggaaatatagtctccctgcaaggtatcccgtaccgcattggtaatggctacccccggtacgagcggcatgatcgaaccgattacaacagtgtccagagtgattgcttcccccatcacttttttcatcacaactgccatcagtcctacgccaaatgacgtcgcaatatcaagaatcaagccatcgatcccaatgacctttgccccagccatcacactggaaagaagaagtcccacaatcagcgttgccagaacatcgtatagagaacctccaaaggagatggtaaatccaactgctaccaccaatggaataaaaaaggcaagtagcggcggatacgggactgactctactctttttaactcttcatatgcatcgataagctcgatctccgctccacaatatcttctggagatctggtttacctgctcaatcacacttaagttggttccccttttttcaattccttgaattaaagtaacaggagcaacctcctctccactgattgatgctgtgattccggtcagcacgaccaaaatctccaccacttccagatgagaagttttcagaatatggtgcatcgtatcctccacccggtaggtctccgccccattttccagcatcagctttccagcaagcattgctgtattcatcaataatttatagtccattctgatgtccttttttgtatcataagttccatttgacatcatactatttctttcggaaaaaatcaacccacaccggaaagccagcctgaaaaaattccaggctggctcttgtataggatttattatagctgaatgtctaattaatgtatcctgctttttttaattcttcttctgctttcgcaagatttgcctcagacacacgaataatcggacccgtacatcccatgccgctctctgcatagatctcgatcttccacagcgcacgcactgcgtcctccagatccataacttcgatgccggcaatctgagctgttacgatttccttcggaggctctttcacttcttcctctgctgcggccggttttgcgactgtcttgtaggaagcaagtacttctttgaaaccacatttctttactgcgtcgaactctctctttgcaacatcaaatactttattacgaacgagttctgcagcatagcagattgcatttgcgattactggtgctccagacgcacgggaaacgatcataacaagttcatcgtacccttccccgattccaggaccatatccgaatcctgttgcctcaaagcttccgcctgtgttgaaagaagaaagcatcttcacaagaatattacctgtcagagaatctgtaacaagaatatccggtgaagcttgaagcacgtcgtttcctctcattacgcaaccgccgtccgcacgtccggactcagcaaatgcaatatcgtaaccgttactctgcagctctttgagtgctttctctgtctggcgcgcgccatccacattgagaataccaacggttggttttgcgattccacatgcctttgctgcaatcacaccgtaaactgcgttcttgatcattccttcgatacgatctgtactggaagttccggttgtattggcgatgaacatttcttttccttttgcaggagttacaacacgcccaacggtagatacgccgatcgggaatgggaagtgcatcgttacagcaccatcgatctctttgttcttcagcatatcttccatcttcttgtggccttcctcgtcgtcagccaccttgattgttgttacgccttctgcttccagagtaccgatgtagtatacatccacaccctgttttgctgccattaccgctgcctgcatggaattttcctcgccgtgttcgctgcccattcctgtcagagcgattttcggacgcctgccgtactgtccgctctccaatccctgtgccatttccataaaggtagaggcaatcactttttcaatactacttgccattttctacacctcactattctgccatcagagtttcagcgaattctttcatagcttttgcgatcaggccttttacttcttcttcagatacagcagattctgcgctgtttccttcatttgcctggattacaaaagatacgccgtcaaagaggttcgtcatacgtccaaggaaaagacttcctttaccgatgatcatagcctttttgatatttccgttcaggatatcttcgcgagcgaatccgatgtatggaacacctgacggaatatgtccctgtgtcggagcccatcctgtcagaccatgcttctcgatgaatgtaggaagctcttttctgtcgatatcgccacgttttacagcaagcgcaccgatcatcttgtagtttgcaagcggtacatcaccagctcctgctggttttgtgatatccgggttctgcatttccggtgagaatttgtcgatatctgttactttccatccagctctgtcaagcggatctgttacaaggcttccgataacagcctgtggagcggagcctgttccaactgtatggcgtccgagaacgtccagattgatttccggatttactccatcattttcagatacaacgacagcgaatccgccaaggcagtcctccagaatcggaaggcctttctttacatggtcttttccgttcataccaagctttgcagtacatcctccggctgttacaacaacggtcttgtatgctccggattttacgagtgctgcagcctcgatcagagcgtgggacggtcctgcacagaatccacgtgcatcggaaccggttgcagatacaagtcctgctacctcagctgcagcttttgcgaagttaccgccgcctctctggttcatatcaccgcacgcttcctccgcacagtcgataacatattccacgtcctctttgttgatgcccgcgttgcggattgcatataacaaagcgagaacgctggaagccttgctcattaagttttcatgcattacatgggcagaaaggttcacgtcgatatcgtgagctgttctgacacatccaacgagctcgttgttgtggtacagtccttcagcatgttcgttttcaatgtaatgtttgatttcatccagctcatagccttcttcgatcttggagataatatcctctgtgatgatcggatcagcagccaaagcgtctttatgtgcgcttacgaagttcttgtctaattttacaacttcgaacatatcgcaagcctgtactaaaagaaggaactcttcttccggcataatttcaccgaattttccgtatctttcagatccttctcttgttttgtcatagtaagggaattcaaccttggaaagttcttccggtgtagcgtttccaatataaacctggtttggccagtaatttacacattcttcataaggacgtaaatgacttcttaattcttttaaatattctgattccggattgacaactctttctgttgtctgtgttgttccgttatatactaccatttctggagtatgtgccaatacatagctggctcctttaattacactgttcattgttagtgtccacctttctttgcgttataaaaggaatgtagttgtaagaaaagcggtgaggtaagtatttaccccaccgcttgtgaatccgaaatccggtatttcagattttcctataaatacttacagtattcgtcacggattgcagacatttcgtctacgatgtcatcaacatcaagaaccatttccatcatgccgacctgctcatcgtataccgcttcatcaaactcttctttcagttctggttcacaaacgtgatatgtcgtgagtccaagctggacccctgtcaatggacctgcgaatgtcgggtcaccagcagtaacagtctcagctgcaagacctgcagcttcaccttcagcagcaccaagtactactactaagttctctggtccgaattcatctgcgaattcttttacccttttctgattctcaagatccattgcgcctgcgctcgttcagacgaaacattctgttgaagaaaaaacaatttctccaccggctgtcttaacgcactctgcgatagccggtcccggaacaccatcacggtcaccaataataatgacttttttaccttctaaaattgccatgatgtttttcctccttcccttcgatttaataattttaagtatttataaaggacaccgctttatgtcctcgtaaagcccttacgggctgttacgcaaatgaagtatgacttgctgttcctatgcgtagtattttttgatcatttcttctactgcttccggagtagcatcgtcttttactaattcctctactttttcaccatctttgtagattgcaataaccggaagtccaaggatcttctggccaattgcaagacgacgtgcttttgtcgtatttaaagatgtaaatttaattttgtcaccatatttctctgcataagagtgaatgtgtggcattaaagcctgacatggcacacatccatctccaaaaaagtctacgagaacatatccttctgcctgcagtacttctggttcaaatgttttcttatctacctctaacatgataaatctcctcctgaactgatcttattcgttttcgttgatatatttctcagcctgtgtagcggcaattgctccatctgcggcagccgttacaacctgacgcaggctcttgatacgaacatctccggcaacaaatacgcccggaatatttgtatgcatgttttcatcggacttgatatatcctctttcgtccatgtcaatcacgccttcaaacaccttggaattcgggatcgttccgataaatccgaatacgccgaacattccatcatcttcgtcagcttcgattgtagtgagctcacctgtctttacattcttcactgtcatggaagaaaggattccatccccatttacttcttctacaacggtatcccataagaagtggagcttatcattcttaaacgccttttcctgaatggacttcgcggcacgaagttcatcacgtctgtggatgatcgtaacttttctcgcgaattttgtaagatacatcgcttcttcaacagcagaatcaccaccgcctactacatacacttcaaaatcttcaaagaagttggcatcgcatgttgcacagtaagaaataccttttcccataaattctttttcgtttttgcatccaatcggacgtgcaaaagcaccggttgcaatgatcactgtttttccaaggtattctgccttggcgcttttcagcttcttcacatcgccatccagctcaacagaattgatcacgtctgttacgcgctccgcgccaaacttctcaacctgctgtgtcattctggcgatcagagaaggtccgctttcaccttctacaatctgccccggatagttttcaatctcatccgtgatagcaatctgtccgccgtcttttcctttttcaatgatcagagtggataagcggcttcttccggcataaaggcctgctgctaatccggctggtcctgctcccaggatgattacgtcataaattttactcataacgtcttactccttctttcatattttgtctttatctgggcatacaggcggaattcccgcccgtatgctgatacccacatgacgtcagtaaaagagctgtctcttatgactgattagttgtcgaatactgtctgatcgtctacttctgtagtaagagcgcttaatgctttctctacgatctctttacgaagtttgtattcttcttctttgtcaagtgccgggttgccaagaggatgaggaatggcaatcgccggaacgattctgttcgcaccaactgtcagggaaattggtgttactgtacagatatgaacaaccggaagtccggctgcttcaatacctttcacgagcgttgcaccgcaacgcgtacaggtacctcatgtggaggtaaggataactgcatctactccatcagctttcatcttcggagcaaattcctcagcaaatgcttttgctgaagcaacggctgttccgttaccaactgttgtgtaaaatttatcgtacagttttccaatttttccttctttttccatttcacgaagtacatcaaccggaagtacacggtcagcatcttcgtttgcatataccgggtcatatccgccgtgagctgtctcaaatgtctcttctgtcagatcatcgattccagcaatgctgtattcgccgtacttagaagcattggaactttcgatatgatccggatttcccttcggaacgataccaccggatgtaaccagagcgatcgttgctttggagagatcctttaccgccgggttcggagcaactctgtcgaaagacggcatcgggtattctgtctcaaatggcttgtcagcaagtttcttaagaagcatcttaaccgcacgtttggatcctctttctttttcgaagaagttcacacgtacaccgttcggcatatatccctcctcacaggaagcaccgattgcttcatgctttgcaagtttcagggcaagcggagccatacttccaactgcttttctcatacctgctgcagagttcttggtagacacggtgtagactttgttcttaaacatatctgcgcccgggttctctgtatacatacctgttactgctggaattccaagctcttcctgtacagcatcacagatcgtaccgcaggcaacgccgtaacgtccggcattaaatgcaggacctgccacgaacacatccggattgtatttctttacaacttccagaatttctgcttttgctttatcaagattttcattgaagtaggagtcgccacagataatagtagctacgatttctgcctcttctccaaatgcctgtttgaatgcaagaccaggtccgatgacttcggcttcgcgaacttctaccggatagtctgctttttcttctccaccgatattagcgaagaactgattgatataatgaactacttttaacatctttcttatcctccctcactatctggcgcttaataagttgaatcctgtttcatttgttgcacccgtaattgcctggatctcaacttcgatcgttccgtcttcacgtaagctgtgctcgttaccgccggcgatggtgttgacataatccagtgttccgatcactttatccattttcggaagtacaattacctggtttgcgtttccgcctgttactactgcatcagcagccggatcagcgtcagcaagtgactgggattttccatcacgtccagcatattcgtctgtgataataacggtcttcacaccttctgcttcgatcttcttacagttcataataaggtctgtatccggattaccgaaaccttcctgagatacaataaccgcgtccagatcaagaagacggcaaagctttgctgtccaatcagaagaacgctgtttgtcagcaaggtatacgttttcgtttgtcaggatctggcatacaaagttgatcgtcttgccgtgttcttcaaagaggtcgtgcacaaccgggttgttttcgtgtacatatgtaggattcttatcacatgcggatacacagttaccggaaacgattgcgccgtccattacttctgtcgggttgatgattgtggaaagagttttctttgcatcaacaccgtatacatatgtatcatgcagaagtccctggctctgaagcatctgtacatatgccactctcggaagtcccggaagtttttccattccttctttgattccatatgtctcatatacttttgtttcgtccggtgtaagctctcttgcaagctcaccaagatatacagcaacacggaatcccgcaaaacgtacagccgcttcatattcatgctgtttaattccatcgatcggctcgcatacaacaacaagattgtttaattttgagaatggtgtgtagtcagctcccggacctgtcatatcgatgataccttcctggaatccgacaattttaccagcagttaccactgccattccctttaatgcgtaggtctttccctcaccaactgtgtcaactttggaaataacgcccgggaaaattcctccacgtccttccaccttgacacgtggctcaataacatctttaaccggagtaattcttacactttctcctggtcttgcaatgtcaaattttacacttttgatgtgctcgtcctcaaggacaacctcttttacagcttcttcggatacataaagaacaccgtcttcgattttagactcagcgccaaactggatgtccttaataaaaatgtgtccaacttctaatctcactgtaattccctccttctaaaaaatgaaatctatgccccaaagtaccccagtacttcattgccatttgtctcctaccaggcatccgcagacgggagtgcactggaaatcagtgtgtaatcaatcagtctgaaatcttcatacacctgaggtgcatattggtcagacttaaactcaaactttccgcaggaagcgatggctctttcgataatctcaatgcccatcagatccgccttgccggccgaaatagaaaccatcacggatttgtatggagtctcattcggcttgacacttccggaaagcgggtgtgtcagaagcttgcatcctctgtatacttcgtcttttactttttccaaaacatcttcgtatgaacattcgtaaaactcaacctggtaatcctgaccgagcttttcacgaacaagggggttgtttgtaataattctaaaatccttcttcatagttccacctattttaaaaagggcggcttttcttccgccgaagcagaatacaaggccgcccttctgtcttatgtatgtcgggtatatctcatacacgattcagaatgtggtcctttccctgatccttttgcctgaaagtttcaccttgtcagtaaggtttgcatcttcggcggttcgtagcgtgaactctctcgcaggaaaaatcatcccactatttaattgtccgcagagtatgtctctcgcatttctgcttcaagtatatcatatggatttatagatttccagcattttattcgttttgtacatagtttttttctataaaacgcctatcttagtcaccttgatatgctttttgttattttttcttctttttctgaagttccggatgcctaggtaggaaattcttgaaataatcgtcgtgcgtcttcttgatcataccactcaacgcaaacagcgcaataatgtttggcactaccatcatactgttgaagcagtccgccatgttccagacaagatctacctttgcaagagaccccagaatcacacagacacatacgagtacagaataaatcggtactgcctttgctccaaacagatacttgatgtttgcttctccgaaaaagtaccatccaacaatcgtagaggatgcaaagaaaaacatacaaattgcgataaaaatttcaccgaacttaccatatacaagagaatacgcaaactggcttaactctgctccagtatatcctccgcttactgcattgtatgattctggaagcgctctcgttgtcacaataacaagcgccgtcatggttaatacgatgaatgtgtcgataaatacgccaatcattgccacatatccttgctgtaccggatgatctactttcgccaccgcatgagcatgaggtgtggaacccataccagcttcgttagagaacagaccgcgggcaacaccttttgtgattgctttggaaatcgtggctccgatcgctcctcccgcgattgcttccggtgcaaatgctcctacaaaaatttcgtagaacgcagttgggatattcttccagttatagaagataatgattaaagatcctgcaatgtaaagagccgccatcaacggaacgatcagctctgtaacctttgcgattctcttcatgccgcctgtaaagatgaacagacagatcaccgcgatcacgatacctgtaatccactgtggaataccaaatgcagtatggaaagaagccgcaatcgaattggactgaaccgcgtttcccataaatccaagcgcaaagatcaagagcacagcaaaaattgccgccaggactttaccaaagactccttgaaacgctgcccggatatagtaaaccggaccacccgttacaacgccgtcttttccgatcttcttgtacttttgcgccataatagcttcgcagtagatcgtcgccattccgaggaaggctgctacccacatccaaaagatcgcacccggaccgccgatggcgatcgctgttgcggcacctgcaatattaccggtacctacctgtgcagcgattgcagtcgcaagagcctggaaagagctcatgccgtccttgccggcatctccctttttggaaaagagacctccaaaagtccgcctcattccttccttaaatcctcttacttgaataaatcccgtacggaacgagaaccagattcctccgaatccaagcgctacaatcaggatgtagtctgaaagataatgttgaatttccagtacaatgttgtttaatgtatccacaacaacccctcctttaccctatagatgttttgaatatttttcctgacatatttataataccattttttgctttattttacaataatttcgtgaattatatcgcttttttgtttattttatccaacttaatatacaagcctgtttactatcgacaaaaaaagggcctgaaagccacgaaatgcgtgggtttcaggcctcatggaatatgcacgattttcataagtttcttttttttatgcatatcgccaaaaatttatcaattttgtttttcaggttctatacatgaatttctgcttttacaccaagatcttctttatgttgctccaataccgggcgtacgacatttgcaaggaatgtatccacctgctctttggcacgtccagtatagtgtgtaggatccattgccttcttaagttcgtccagactcagattaaaggacggatcagccgcgatcagttccagaagattattatcaagccctttttccttgacattttttcctgcctccatggagagctctcggatacgctcgtgaagctcctgacggtccccgcctgcctttaccgcatccatcatgatattttctgtcgccataaacggaagctctgccatcaggtgcttttcgatcaccttcgggtaaacgaccagaccgtccactacattcagacaaagatccaggataccgtcgattgccaggaatccttccggtacggatagacgcttattcgccgagtcatccagggtacgctcaaaccactgtgttgctgaggtgatcgctggatttaaggcatccacaatcacatagcgggccaaagaggcaatccgttcgcttcgcatcgggtttctcttatatgccatggctgaggaaccgatctgattcttctcaaatggctcttctacctcctttagatgctggagcagacggatatcattggacattttgtgggcacttgcggcaattcctgccagaatgttcagaactctcgtatccacttttcgggagtaggtttgcccggaaaccggatagcaggcagaaaatcccatcttcttagcaattatcggatcaatcttatcaatagtctcctggtctccctcaaaaagctccaaaaagcttgcctgggttcctgtagttcctttggagccaagaagctttaaggacccactaacatattccagatcttccagatccattagaaactcctggagccagagtgtcgctctctttcctacagtcgtcggctgcgccggctggaaatgagtaaaagcaagagtcggctgtgctttatagcggtccgcaaaccgtgaaagttcgtcgatcacactcacaagtttctttctaatcagctttaaggcttctgccatcacaatgatatcggtgttgtctccgacatagcaggaggtcgctcccaggtgaataatccctttggctttcggacactgttggccgtaagcgtacacatgggacatgacgtcgtggcgtacaagcttttcacgctctttagccacttcataattgatgtcgtctgcatgtgcctttaactcttcgatctgctcctccgtgatcggaaggccgagctccttttctgtctctgccaaggcgatccaaagttttctccatgtgcggaatttcatatctggagaaaaaatatactgcatttctttacttgcataccgttctgataatggactctgatatctgtcgttcactgtttcatgctccttttcctaaacttggggtcaataccctttttgtattcctactatactacagaagatccggaagcgcaaccggatcttctttgaatgaccggctgttattcctttctataaataccgtctgtactgatgtttccacgcctctagtgtctcctgcggcgtttcgaggctttctttagccgtcttttcttcttccagcagccggattcgatcagcgatctccgcgtaatcgggatgttcagcaagaaacttttgatactcctcttccggaagataccgtgatcgggcatatacataggctgccagcatcgtctcgtcctggcagatctcatacgcctttaagtacatttccgccgcctgttcatagagcagctccctcccataggcagcaccaaggcaaccgtataccttcccataaaaacgctcgcctgcggactcatccctctcatcctggagaatggaaagataaacgaggattgccgattcgtactctccacttgccagcaggttatcagctttatattttctgcgctcaatctccttctgatctttcagacgatccagaacattgcggatgtgctccatctccggttccgaatagatctttgcttgttccagaatccgaagtacgaactgttcaatcgttccgtttttctgaagcaggtcaagaaggtctcttgccagctccttcatatcaagctctgaatacagccactcacaaattttctcattcataatggtgtagtcaatcagatacagattattacagagataatagcacagttcttctatcgtatagatctttctgtgaatccgtgtgattttgtatggctgtgaagcctttttcttatgacaaagaattaaactgcccatttgtacctcccagatgaatgattttttctaccctgaaatccgtagccgggaagaaatccccgaaccctgcatcccggaaactcaggcggcacgtcctctcatcatcaaactccgtacggacaatcagcttgagagaatattcttttctctttggcatccccgcaaaagagaccgtctctacattccactgtcctgtcgccagcgactcaatatgaatttcaatatcctccgtattttctaaaaggacctcccattctcttgtatcttcataccagtgggtgccaaactccacaatcgggtaccatacatctactccatgaatcctcatcttgagacagatctgttccatcagctttgtctcatccagataggttggtacatccggagtttccgaacgctttttcagaccgcaataacatgcccccttactatacagattgtttccaataaatgctctacgtccattacacagcaccttctgagagttcggataccagttattttcaaaaccttcccccgtcagatagacagaggaaacatgtttcttattaaaaacaccttgaatgaaattccgaaaccgttcatccgcatttctagccttatctacattcagcaccggatagaccgccctaagctcttccatctgtgcctctgccaccttctccacactgacaaagctttctttctctcttctgtagtccgtgttaagctgctttagcatgtaagcttcaatcttttccctgtcacagtaaaagagcgcggattcatactgccagagctcttttggctgataaagcatatagtaacagaagctctcccggtaatccatggcgtagactcggcttttatcaatacctgcctgggctccggcttcacgtaaaaaggtacggatatcctgatcaatccacggtacggtaaacgatacaaaggagacctctttctttcggaatgtctggagggtcagctcaataaacttgccaagaagccatcttgcctcatagactgtcccttcgatctcaatctgttcttttctctgagccttgcggtagagatctgaaacgacccagcccttttccatcatagctgcccgctgagcctcgcgtccgaacatccatgcctctttgtaatgtcccaccatcatcggaatctggtaattgtcagccgccacttccagcgtcttaagttcatgcttttcttcatcataatagctgatttggcagccgttttcattcaggtcatagccaatgatataaccacaattttccatcctgatccttctcctcttttagtataccataaacagctcctgcgacagttccttctcgcggctgtattcattcattgcctgtttcagcgcttctttcgtcagctccgacatatcgttcagccgtccgtacgttccgatagccggtacttcgtgttccagacgaaatgtctgcatgtcagacgcaaacgtactgccgtcagctttcatctctttgaagcggtattccaagatctcatcactatacaggacaaaggtccttacatgaatcccctcataggccgcctgcatgatctctttctggtatggttgatcctccgtccgttctctggccttttggatcttgtactcgatcatcacctggcttcctttctttgcccggtattcgacaatacatttgtcataaagcataacttccatcagccaagactgtggatatttcaaataaaaagaaaagacaacctgtttttcacaaagttcccgcaagaaccgtttcagaagctcctctgacgcagtctggatctcatgctcagaataatacttcagataggcaatccggcaaatgtccggcagcacctctccggcctcttcttcctttctaacaatctcccatactgacagatcagtctgccggtcacgtatcagatactccctggatatgtaggcaagatatgctctctttaggcggaagtaggtattgccgctgccatagtaatcacagaagatggcttcctcaccgaaaatattctctgaaaataccatctgggtgataattcgctcggcaatgcgatccgaaggaattccctccttctttgccgcgcgccataccctcttcatatttcttgtggctccacaatagtatattgccagatagctgagtgtcgtatggtcagagtatccttttgtgaacaacacgtaacagagctctgtaagcatctcatcctcttcgtaaccgtcctctaaaattttctttgaacaaagatcaaaaacctctccgtccacgaacggatccataccgtgcttcttgatattttcaaaggaaagttccggtacagcaaccggctcttccggaacctccttatttttctccagttgtttgcagaactctacaaaccgcatctcgtagaacagacgtgtcgtctcatatggaatagaatccgtataatgtcgtccgtccatggactcccaaataattctggaatccttatcatagaggaagatcatggctttgccatcgatcacaccgactctttgacggatttctccatcctcctcaataaccattaccgatttcataaacggcagattcgtcttcacctcgtaagcatgacaaatatcattgagcgcttccagacgctcctgtgtcatattctcctccgtacagaacttcttataaataatccgaagcggctcattaatatgtctttttaaaagctgctcccagccaaattcctgcatcttgtcacggtagtaattgtaaatctcacttgtctcctcctggaactgaattatatttgcgtagaggaaagcagtcttttcgtaagtaagcgtattcccatgcatgaagtagagacagacagctttcggaagcggcgtacgtacccgctcctcctcaatcgtcatcatataatattcgtagagctgtacgatcttcatctcctgttctaccgcaagctcataccatttgaaatattcagaacaaatctgattccccttaataagaagcgtgcagaccgcagtcagtaccataggatccgggtactctccatagagtttttctaaaagacggaacaactgtctgtcgaatttcttctgctgccctgccagatttgctgtgtaaagagcaagctcccttgtgaagagtccgtaccgacatccaaagcccagtacttgaatctcgaaattgccaagctttttcaaagaaaccggatcctccctgtaacacttaaatgcctgtagatataacaatgtatgaccgaatttttctgaataaaaatgcttctccagggcagcaagtcttcgcgtaatattgcggtactccggatcaatatccaccagcatacaaaggacgctccacatcttcggatgcttattatatgccttgcgaagctcctctgttacatgttccgtgtggcttgcattgcgctttaacaatgcagtaagatacaggtagtaggttgtattctcaggccgcttcatcatatcaaaacggccgtaattatactgctcaataatctccgccgcctgttctgtctgtccgctctccaagtaagcgtgcgcttttacaagggaacaaaacgcggcgtcccggccaaggttctccatctgtcccgcaagctggatcgtatcttccgcccagcttaatagatcactctttccggtaatgcaggagaaatagccctttacaatctgtgtcatataaaacgtctgctcatgctttggtgtatggactccctgtcgtgtgacttcgatttcgtagacgacctgctcatacggtgtagtaaagatgattcgtccaaaatttcttccggcgtgaagcacctgtggagtaatgacatagtgaaacccaaatgtattcccgacgaaatcatccgtagtaaattccttttgcgtgatctgtataaaaccgccttccactgtggcacggatcggcatgtagccccatgtattctttgtaataatcaggttctcccgaaccgcatcggtgatgctttcaaacttcttctcatattcagacagagagaggaaaagacattccttctgtttgatgccgacgagaaattcctccaccgcctgttcgcccagagaccacttcctcatattattgtaaagagctactactctcggattttcgtagcgcagaatctcataaaaactcatggaacgaaacaatctgcgtgcttccatgaagtccgtcatagccaaaagcttaaaatctttcatattttgtactttcccgtgagaagtcatcaaatatggccgctcgattaccgccgtaaaagaaagctcgtactcgccgccgttgcacacaatatagaacgtaccattctccacatatcccggatccagaccatctgtatcgtaagtgaaagaaatctccaccggatttccctcaaatccattctctgtcagatgaatacgaaaagaagaggaataaacaattcctcttatcagcgcttcctttttactttcaatcgtaaaacttccctggtaggtctccccttctccgatcaggagcaccagattcgtctccgaaaacttcacttctggctgctccttgctaaaatctccatttgaaaagcgtttaattttatttttcaagcctgccacctcttgcattgcattttttatcagatatactataattgaaattataacattattccctgtcaaatggcaatccctgtgcataatttatcagaatttgtcatatgcgaagatttcgctgcgccggcagcataaaaacggcgcaagctgcgaatctgagctacagactgaattgacggaactgctacagttgtttgctatcataaaaaggaggcaattcgtatgagtcagacaccaatttttcatggaagtgatctggagcagatcgcatcctattatcatatagaatctgacgagatctgctgtttttccgcaaatgtcaatcctcttggttttcctgaacagacagctctggctgtctgcaagaatttttctcatctgatgtcacgatatccggatcgaaattatatcggactgagagcagccatcggccgctactgtcatatttctccggattatgtgtcggtgggaaatggttctaccgagctgatttcccttttgatccagtcttgtcaaagacaccatgctgtccaggtaggaccatcctactcggaatacgagcgggaattacagctttcgggtatctcttactctacctggtttccgaaaaaggaagatcatttccggattcataccggagagctgattgacgctttgaaaaaaagccatgcagattttctgattctttgtaatccgaacaatcctactgcctctgccctttctcaagaagagcttgccgttcttctccgcggatgccttaagcggggcgttttcgtaatgattgacgagacttatgccgaatttgcatgtcgcaatgtttctgccattcctctcgtcccggagtttccaaatctgatggtgatccgtggcatttctaaattttttgcagctccgggcctgcgcttagggtacggcgtctccagcaacgcagaattccttgcccacctgaaaaaagtgcagaatccgtggagcgtcagcagcattgccgcctttgccggagaacatctttttgcggaaaccgagtttatcgtaaaaacaaaagtcctcatatcccgcgagcgcacccgcatgatacaaggactttcagaaatttccaagctgtgtgtctatccaagcgacagcaactttctgtttgtcgagatcctggattccgtctttacatcgcccggattatttgactttctgattcgtcagaaactgatgatccgcgactgttcctcatttccggggcttggcagccagttttttcgcttctgcctgatgcagccggaagataataccagacttttgcaggcaattcagagctatttctgttcctaagtattgccattttaagcaattttaactatttcgtgacaattttatagtattctcttgcggtcagtttgaatacgaggccgtagatcacgctgaatacgagaagcgtaccgatggtacaggtgataaacagattgacattcgtcaggttgaagcttgcgagaagtcttctcattagctggaaggccgccgctacatggagcgtggcaagaccaagcggcaggaagaataccatacggatctggctgttgaccgtctttttgacttcccggcgactcatgccgactttctgcataatctggtaccggttgcggtcctcaaatccttcggaaatctgcttataatagataatcaataccgttgccatcaaaaacaacccgccaaggaaaatgccaaggaagaggaagcttccgtagaacgtatgaaaatcttcttcatacataccccgaagttctatatcacatgcaatcccgtaatcattccggagccggtttgtgatggccgtagccgctgcttctttcttcgcttcacttccatccagatcaaatccataggaatactggaaagtcgctgcttccccacccgaaagtgaggaaatgaggttctggactgtacccacatcttttacaaaaagagtcaaggtatccattaccggaaattcctgtttctcttccatcgggatctcatccggctcttttacaatggtaaagtccacgccatccagccggaagtggtctttgccgtaattctctttagaagaagagaaaataaccgcttcattatcagcaagcttaatctcgtcttgattcatctcattgtaataggagactggtgcaatctgaatcagagtcttgttaaaataaaaggtactgtcaaaggagtccaccgtatattcttctcctttgccatccgccacaagggaagtatactggcaccgataaccgtttttctgtctgaggccctgtcggttcatctcttctgctacaacagtatccaccgtcctggtcagattctcatccgactgataaactgaaagaatcagctccttggggaatcgatttgacataatattttccatacccatattcaaactgaccgtggtagaaagcgttaccagaaccatggtgcttaaaatacaaatattggcaagtccaacggcattttgcttcatccggtaaatcataccagacacggaatgaaaatgctttgctttataataaaacgacttcttctttctcagcatctttaaaaaggcgatactgcctgctacaaacagagcgtacgttcccacaataaccagaagaaccgccacaaagaagacgctgatggcctcgatcgggttttccacgatattcgcaagtacataacctgtggcaatggacgcaatcccaaagagtgtcagtaaaatcttcgtcttcggctccttttctccgatagatccgccccggagcagctcgatcggatttgcttttcttacctgcaacaggttgaatgcgaaggtgataaatgtaatcgccacaaagaggagcacggttgagctgacgctgccagcggaaatctcgtactgtaaaggcgtctcgtatccgacgatcttataaagcaaaagaaacatcagttttccgaaaatcgccccgccgatcagtccgatcacaatactgattccacctgttgtcagagattcccagaacatcataatggagagctctttctttcccattccaaggacattgtacaggccaatctcttttcttctctgcttaatcaaaaagctgttcgtataaaacaagaagatgaaggcaaagatggccacgatcaccataccaaatccaaggatactccgcatactgtccgctcccggcatctctctgacaccggagttgtccatgatcatgtacatgtcaaaaaacatcatgatggtgatgatgctcgtaagcagaaacgggacataggaccgcttattttttttcagattggtaagggcaagcctgatgtaaatcgatttaaacataccgctcacctcccgtagtcagcactgtcagggtgtcggaaatcttctggtaaagctcttcatttctcatctttccgcgataaatctgatgaaaaacctcaccgtctttgataaagagcactcttcccgcatgactcgcagcctttacggaatgtgtaaccatgaggattgtctgtcctttttcattgatccgggtgaactgatttaacagatcatccgctgccctggagtcaagagctccggtcggctcatctgctaaaatcaactgcggttttgtaatcagtgctcttgcgactgccgttctttgcttctgcccgccggacacctcataagggaattttgccaacagctcgtagatcccaaggctctttgcaatcggtactaatcgcttttccatctctgcgtactttttccccgcaagcacaagtggaaggaaaatattatcccggatggaaagggtatccaggagattaaaatcctggaacacaaatcccagattctgtcttcggaaagcggcgatctctttctccggaacggaggaaagctcccttccctttaatttcacatggcctcctgtaggcttatccagcgccgccaggatgttcagaagtgtcgttttacctgatccggattctcccatgatcgcgacgtactctccctcctccactgaaaaagtaacgtttttcagggcttccacctgggcaccgccaaaccgcgtcgtatatgttttctttagattctgaacttcaagaattgtcatgttcatctccgcctttctgaattcttttatgtttctatgctgtcattatagccagaatgaccgagtattttccatcgattcttcttacaatccaagcccgaaccttacgattttgaaaggtagcgtcctttattccagatcaagctgtgtccgtctcagatccaggacgaccttcgtcccttttccatcttcagaatcgatccgaagctggtgatggagcttatccatcacttttttgcaaagatataatccaattccggtggagcgtttatcgatccgcccattgtatccggtatagcctttctccataatccgcggcagatcctccgccgaaataccaatgcctgtatcctttatgacaaggactccctcctgttccaggtaaatggagacacttccgctctttgtatatttcagtgcattagagagaatctgctccaccacaaaagacagccacttttcatctgtgaggactatctcggcaatctcccccatttccagggacagtttctgtaaaataaacagtctggaatacttcttgactgcctgccttacgactttacctagatcgcagcgctccagcaccatatctttggcgatgtcgcctatcttcagataagaaagcaccatctccacgtactgctctgtcttaaagagctccatctgaagctggcgaaacagcttctggttctcttcattctcctcccgatccattccggattggacaagaatccgcatggctgcgataggcgtcttgatctgatgcgcccacataccgtagtagtccatcatctccgtgtaacgtttctgatcttcaaaaataatctcttccttctcctgtctcatctttgcgatcatcgaacggtacaacgcttccagatctcccggcactgtataaaacatgcccggataggtatctgaggtggcaatgcaccgcttcagctctttccaccgctccgcatatttcaggatgtccaccagcaggcagagaaaaacacccgccccggaaaactcggcgatatagcgtgtcttctcgaaaggaatatcatacagatatccaatcaaaaataaggtaccatagcagatcagaaggcatccgaacatggcggcccggtctctcatatatcctttcagcatagtcgtctcactcctttaaaagataaccgattccttttttcgtcaaaatcagatcagaaagtccggccttgtccagtttcttccgaagtctcgtcatgttcaccgtcaaggtgttgtcgtctatgaagctgtcatcctcccagagctttgtgataatatcctctctggagacaatctttccggcccgctccatcagacactggagaatccggtattcatttttcgtcaaatcaatcttttctccctcgtagagtaccgtagcgtcgcttaaatttaagagcaatccctggtgctcaatgacattgacatttccctggaacgaatagcttcttcttaaaagtgcctgaatcttggcggtgaggacattgaggtcaaagggcttttcgataaagtcgtctccgcccatattcatcgccatgacgatattcatattgtccgacgctgaggacagaaaaataatcggcaccttggaaaattcccggatccgctggcaccagtggaatccgttaaaaaacggcaggatgatatccagaagaatcagatgcggggtaaaatctgccgtctcctccagtacatttttgaaatcttcaatgcatctcacctcaaagccccactggcacaaatggttctttagtgttccggcaataatactgtcgtcttccacaatcaaaatcttgtacattgtgtctcccttctgctgtcaaaccatcaagcgctatgatccctaagaaccatagcgcttctttttatgttttgtctttgattatactactgaacttttgcaatatcaatcaaagtcagctctttgatattggtattttccagactcgttacaagtgcccctgccgtatccatggcggtcagcactgtcacaccggtctcaatggcatttctgcggatcgtaaatccgtcccgtgcgtggtccgctccctgcggtggtgtatcaatgacaagatcgatctcatgtccgaggatcagatccagaaggttcggggaagcctgctcaatcttgttgacggcaatggctttcacaccggcttctttgagtgcctccgcagtccctgccgtagcaaaaatccggtagccgagtgtctcaaatctgcgtccaatctccactgcctccggcttgtcctcatcccgtacggtcataatcatattcttgtatttcggaagcttgatacctgctccaaggaacgctttgtagagcgcctcattaaacgtcttagcaattccgagacattctcctgtagacttcatctctggtcccagactgatatccgcgccacgaatcttctcaaaggaaaataccggcatcttgatagcgatgtactctgcttccttttgcagtcccggtgtatatcccagatcccggatcttgtgtccaataatgacttttgtcgccagcggcacaatcggaattcctgtcaccttgctgatgtatggtaccgtacggctggatcttggattgacctcgatcacataaacatcctctccgcacacgataaactgaatgttgatcattccaatgacatgaagagctttagccagtctccttgtgtactcctcgatcttccgttttgtaacagccgaaatactctgtgccgggtataccgagatactgtctccggagtgaatacctgcacgctcaatatgctccatgatgccgggaatcaggatatcctctccatcgcacactgcgtcaacctcgatctcttttcccataaggtatttgtctacgaggattggatgttcctgtgcgatccggttgatgataccgataaattcatcgatatcgtggtcgttgatagcaatctgcatgccctgtcctccaaggacgtaggacgggcgaaccagtaccgggtagcccagttcatttgccactttctttgcctcctcggcggtaaagaccgttcctccggtcggacgtggaatcttacattgtgcaagaatctcgtcaaaaagctcccggtcctctgctgcatccacattctccgccgaagtaccgaagatcggaactcccatcttcatcagcgcctcggtcagcttgatggctgtctgaccaccaaactgcacaaccgctccgtccggtttttcgatgttgacgatactctctacatcttccggcgtcagcggctcgaagtaaagtttgtccgcaatgtcaaaatccgtgctgaccgtctccgggttattgttgacaatgatcgtctcgtagccttctttcttaaaggcccaggtacagtgtacggagcagaagtcaaactcgatcccctgaccgatccggatcgggccggaacctagaacgagcactttcttcttgccgcttgttttttctacttcattttcgcttccaaaaacagagtaatagtacggtgtggtggcagcaaactcagccgcacaggtatctaccatcttataggctgcagtgataccatattctatccgcaactgatggatctcgttctctgtcttcccggttagagacgcgatgacgtgatccggaaactcaatccgttttgcttcttttagaagttccggtgtcaaaggcccctctttgagagactgctccatctctacgaggattgcgagtttatcaataaaccatttatcaattttcgtaatgctgtacagaacatcgtaagctacgcctcttcgtaatgcctccgcaatcatccagatccgtctgtcgtctacgacatgaagctgttccatcagctcctcgtcggaaagtccggagaaatcgtaggacatcaggctgtccacgtgctgctccaaagagcggatcgctttcatcaacgcaccttcaaagttatcgcagatactcatcacctctccggtcgccttcatctgggtggtcagcgttctctgggcactgataaatttatcaaatggcagacgtgggatttttaccacgcagtagtccagcatcggctcaaagcttgcgtacgtctttccggtgatggcatttttgatctcatccaaagtataaccaagggcaatcttcgccgccaccttggcaatcggataccctgtcgctttggacgccagggcggaagaacggctcacacgaggattaacttcgattacacagtattcaaaagtgtccggatgcagggcatactgtacgttacatccccctgtgatattcagctcactgataatattcagagcggaagtacgcagcatctggtattctttgtcacccaatgtctgggacggagccacaacgatactgtctccggtatgtacgccgaccgggtcaatattttccatattacataccgtgatacagttaccgtttccgtcccgcatcacctcatattcaatttctttccatccggcaatgcagcgctccacaagcacctggcccacccgtgaaaggcgaagaccattctccagaatctccaccagttcttccctgtcatgggcaattccaccgccgcttcctcctaaggtataggccggacgaagtacaacaggataaccgatcttctctgcaaattccacaccttccggtacgctctccacaacaagggaagctgccaccggctctccgattttttccatggtggccttgaattccagacggtcctccgcctttttgatggtttcagaggtcgttccgatgagccgtacattgttctccttcaaaaatcccgtctcatcaagctccatggcaagattcagaccggcctgtcctcccagagtcggaagtacgctgtccggacgttctttcttgataagttcttccacgacttccacggtgagcggctcaatgtatacacggtcagctatatccttatccgtcataatggtagccgggttggagtttaacagtacgacttcgatcccttcttctttcagggaacggcatgcctgggtacccgcatagtcaaactctgctgcctgcccgatgacaatcggtccggatccgatcactagtacttttttaatatcctgatttcttggcattactgattccctcccatcatttccataaaccggtcaaaaagatatccggagtcttgcggtcccggacatgcctccgggtgaaactgaacggtgaaaatcttctttccggtatatttgagtccttcgtttgtcccgtcattgacattaacaaaggcaggcgtagcgatttcatcgcttaatgtggcgtcatccaccacatagccatggttctgcgaggaaatataaacccggttgttacttaaatctttgaccggatgattgccgccccggtgtccgtatttcagtttgtgagtgtctccgccatttgcaagggccataagctgatggccaagacagatggcaaagatcggtacatcgctttcatacagctttctgacttcctcgatgatgtcggtacaggtctttggatccccaggcccgttggaaagcatgataccgtccggatgggtggccagaatctcctccgcctttgtatgcgccgggtaaactgttacttcacagcccctcttattcaacgatctggcaatattgttctttgcaccgtaatccagaagcgccaccttgtagctatctcctggaaggacgtaagcttcatcacaagtcaccttggaaaccacatcgcccacttcatatgcggcaagctttggcaaaatctcctcaagatcatagttctcattcgtcgtaatcatgccgttcatggtgcccttttcccgcaaaatctttgtcagggctcttgtatcgatccctttgattcccggaatatcctgtttttccaaaaactcctggagcgttccttcgcagcgaaagttgctcggcattctggacagttctcttacgatatagccgtccggccacgcttttttcgactccatatcaggagtaataccataatttccaattaacgggtaagtcatcacaactgcctgtccggcataagacgggtccgtcaggacctcaagataacctgtcatagaggtgttaaagacaatttcactgatcatatctcgcttcgagccaatactcgttccttcaaagacggtgccgtcttccaaaatcagaaatgctttcatagcttcaccttatcccttcgtagtttctatttgtttgtttgcgcaaaaagaaaggcgcatgagtgtctttttcgatactcgagcgccctccttctcaaattgtaaagattttaccacatctctttttctttttcaacgcttttcctgaatttttttacaaactattcagccatgctcttattcatactgccagtacacggtgatcttatacagcacctcgtcatcctgataggaataccttgcactggagagctgataccaggctgcaagattcgaagccccctcacggatcagattgtttaaaagtatctccctggattcctcgtaggctgccttcccggaaaacttaaaaaccgaaacttcttttccggcagaaatctcggtgtttagctgttttctcatccgctctttgtcaaatcgctgataatagcacccttcccgtacgtagtaattgtcctgaagggaagtacaggacggcatcgggacttccccgtccagctcatgggtccggaaaagctcttcctcattgcagcagagataatcgtactgaatctgctgggcttcagaaatctcgcttggatcgctttgcaggaataccggatccccccatgttgtatcgacatagtagtaattgccctcgcaccgtaccagattccacgcatggggctgtccccttgtcgtcccggtcacataggtgcagaatacgccgagcttctccagaagatactgggtctccctggcatatccggcacaaacggattcttttcccacaagtgcgctgaaaagattctgactgtcgctggcatctgccacataatctacagtccggatcacatattcatacacatacttgattctgtcgtactccgatgccgactggatctcttgcacctgttcaagaaacgccttagtttctgcattgatttttctctgcatctgctccttcgtctctccttcataggtgtactccggacagatctgtgcatatctgccctccggaatctgataggctgtcgtctccgcagcaccgctgcaccagaaaatgtccggaaaatcgttcagaacaaactggaagatctgattcacccgcttggcttcggtcatcggtacatcgattcccttctgattctccctgattccctgaagaatcgtctcataaactcttttttcctcttcatttaatgcctgataataaaatttctcctctacttccccggcgggaacctcctgtgtctttaccaccggcgccgcctgttctgtgaaaaaagtgagcttctctttggacacaaagccggtatcctttaacattccaacaatacctgttgcaactgccagaatcaaaaccgcgcacagaactacgcatccttttaagaatctgttttctcttcttctcatgctaatctccgtaactcatcctttactttctattatagatatatcccagccttcggcgcaaccagaactttataccagttctgcaatacgggatacgccgacatagacttccgaaatcttataccaggtccggtagtctacttttccggtctgcggcagtccgaatacttcctggaatttccgcaccgaagcctctgttctcggcccatagacgccgtccgcatctactttcggaatagcaggataagcacctgcaatgacattaagctgctcctgcatctgaagcaccttgtctccagtagaaccattctccagtgtatatcctggccacgacgccgggactcctgagatctcctgggccgtgttgatgtacatatcacttccatagaaagagcgcaggatctgaatcgccgtgtatccctgatccgccagactcttggatccccattgggtcatccagccgggacatgacacctgctttccatcacagtactgcgtcagaatcggctggcggacattcggccttgacagataagaagcaaacaaatcatccaccacagaagaaatcgtatcgtagatattgcgcctgggaatccacttatggtcaaaggctgtagaggaagaaatcgtgaaatcaaatccctgattccgataccattccgtatacacccgatttaacgtaaaggacataatggcaaggacgttggccttgattgcctccacaggccaggtagcatagatttcgctggaagcgacattcttgatgtaatccttatagcggtcatagtaattgagagccgtggtgtcccgcggcgatccgtcgtgtaccacgacatattccggtaccaccacccgacttaatacaatctctcccgtctcattcaccggtttgatctctgcctctggaattttcggcggataattgccgaacagcgtgtgagccgggatcacatacacctgctctccttcttcccgcgtaatcggaagaagacggatgttttgaagagccgtcaccccagagaggatctctgtccccgcaatctggatagtctcaaatcccggagctgtcacttccagcgtatactcggagtacggctgttcctcctgccgttcatcgaggctgtactctaccggaggcgccgcaagctccagcgtctcagtctgcccggatgaatcggtggaaaccatctccagtgtattctctggtactccggtataggaaatccgcacactggcgtcctctaccggaaacgcagttgcctccgaagtaatctgtatttttagccttcctttatcgatgttgttttcctgcatatgatataatgtgctcattttatcatcaccctgtcacagttctcttatcatcagaatatgtgtggaacccgaaaatcatgtcataaaattcacgttgtaaaagaggaaaattttctatgaaataaaaaaacgggatgccaccacaaaatgacgctcccgttatcctatcccatatttcccatcagaaaaaaactctttgaatatcatggtacatgacgaataccatcaaaagcaacaagcaaaccatgccaatcatatgaacatagccctctttctccggcggcactcgcttgccgcggatcacttcgatcaccaaaaaaaccagacgtccaccgtctagtgccgggatcggaagcagattcatcacacccaggtttgctgagagtaaaatcatcagattgagcatattgaggaatacaagcgccgctcctccgcttttgctctgattgtaagtgtcttgaacgacatccacgattcctaccggtccggacatactttccatgccgatctgccccgtgacaagcatctttaagctttccagagtcgtactgatccagtaacggaccacggaaccaccatagcggatcgtctccagcaccccggcttttgtgtaagcccctccgctgtaaccgtaacggtacatcccatacttttcatcccactgaggctttaggtgaaccgtcgtctccttgccgttccgttcataagtcaaatcgatctcttccttctggtggaactggttaaaggtggtaatatcccgaaataggtgaatcttctttccattaatctgtgtaatcacgtctcctgcctgcataccggcctcggctgccggataacccgcttctatcgaagatactaccggtctgtcaacaccgatccacgccgtaataatgatagcgccaatcaacgccagcacaaaattaaagaccggtcccgccgcaatgacactgatacgtcgccacggagatttttcattgaaattccccacggattcaccggcatcgctttcgtcctctcccatggcgcagaaccctccaagaggaagcacccgaatcgagtagagcgtttcctttctctgaaatccgaaaagcttcggacccattccgatcgaaaactcctgcacttcaatcccattgaactttgccagtaagaagtgccccagctcatggataaagacgataaatccgaatatgataattgcaagaataattcccaaatcctgttttacctcctgctgcgaattcgttcataagtttcctgttctgccgtaaggatctgttccaaggacggggagttgatattgtgatgtgcccgcatacagtcctcgatgatctccacgatttccaggtaagtaatctctctgtttaaaaacatggctaccgccagttcattggccgcattgaacacggtcggcaagctgcctccggttctgcctgcctcataggcaagagaaagtccgtaaaaggtgtccatatccggcttttcaaagtccaggtgagtaagactccagaaatctaagcgatctcctggcaaataacgtctctgaggataataaagcgcatactggatcgggagcttcatatccggtgtgccaagctgggcgatcacggaaccatcttcatattctaccatcgaatggatgacagactgcggctgtacaacaacctgaatatcgtctatctctacatcgaacagccattttgcctcaatgacttccagtcccttattgaccatggtagaagaatcgatcgtaatcttccttcccatagaccagttcggatgcttcagagcatcttccactttgacgtttaacagatcttcttcccttttcccacggaacggtcctccggaagcagtcagcaaaatcttttgaatccgatttcccgcatttccctgcagagactgaaaaatagcgctgtgctcactgtccaccggaagaatccgtatccctttttccctggcaagggggataatcaaatgtcctgctgtcaccaaggtctctttattggcaagggcaatatctttccccgcctcgatggccgcaatggtggggcggattcctatcatgccgacaactgccgtgaccacaatttccgcctcaggaacacaagcagtctcaatcaggccgtccattcctgtaacaattcggactgctacgtcttttaaccgctcccgaaactcccgtgccttctcctcctcgtagacacagacaacctgaggatgaaattcccgcacctgctgctcgagaagctctgtattagaacctgccgcaagggaaatgacctcgatatccccattctcacgcaccacctcgagagtctgtgtcccgatagaacctgtagatcctaaaatagctattttcttcatattatttctcctgatctgtataaagcctatttatatcataaaaaatacactcagatagtagatgatcggcgccgtgaaaatcacgctgtcaaaccggtccaaaatcccgccgtgtcccggaatcagttttccataatccttgatttcatgatttctcttgatggcggacgccgccaggtctccgaccatagagatcagtcctccggctccacagatcaccgcatacactacgggacttgcagacgcatccccgaaatggctgactgccgccgcatacactgctcccagaagcgctgctcccacaacgcctccgacagcgccctccacagatttcttcggactcagtttcggagacatcttatgctttccaatcaacatacccacacagtaagcacaggtgtcgcatccccaggaagaaagaaataccagccacaccagatagacaccttcttccggaatcattcgtgtctgataaacataggacaacatcagcgccacatagaaaatcccaaaaaagacgagcatcatttcttccgccacatatttaggataggaaaagacatagactgccatcaagatgatcaaaatcgcaatcaccaaaagcccaagcccctgtctgtcaaaaaaagcaagtacttcgctctctcctgatcctttcacctggagacggatcagcacgtaacaggcggcggcagcagcatatcccacaataccaggaagcgagacgtgcagattccgtactttataaagctcgctcattccgatcaggctgaccagaagaagtagagcaagcaatatatcattcccgggaataatcgtggcaagagcaatcaccacaagcagaatcccactcaaaagccttgtcttaaacatccgcctcttcctcctttacctttccgtatctacgctctcttttattatattgcagaattgccttttctaattcctcttttgtaaaatccggccacagaacgtccgtaaaataaaattccgtgtacgccatctgccagagaagatagttggacagccgaagctctccgcttgtacggattagaagatccggatccggaatcccatgagtatccagatacgtctcaaacagtgtctcatcaatctcctcaggattcactgttccctctcgaacgtctgacgccatccgtctgatggcacgcaccatctcatcccggctgccgtaattgatggcgatctggaaattcagcccatcatttccggcagaagcctcctcaagctcctcgatccgcgtccggatatcatcatccagcccggtcttatctccgatgacccgaacccgcatccggtttttctctgcggtcttcagacaggtcttcatataatttcgcagaagcttcatcaacgcattgacctcgtccgacgggcggctccagttctccgtggagaatgcatagaccgtcaaatatttgatccccatcttgtaggcaatctcacagatcctctccacgttcttgctcccctgggcatgtccgtaattgcgaggcatatttttctttttcgcccatctcccgtttccgtccagaataatggcgacgtgttgcggtatcttcatcctttctcctccttgacacatacataagagcaagaaggaattccctccttgctctgctcttgttatcttcttatacggtcataacttctttcgtcttggcttctactgcactgtcgacttctttgatgtacttatccgtcattttctgaagttcgtcttccatatctttgatctcgtcctccgagatttctgtgccttttaacttcttacatgcgtcgttaccatctctgcggatattgcggatcgcaatcttcgcctgctcaccttttttctttacgtcttttgcaagctctttacgccggtcctctgtcagctctggaaatacaaggcgtatcacctgtccgtcattggtcggattgattccgatatccgacgtctggatcgctttggtaatctcctttaacatactcttctcccacggctgaatctgaatcatccgcgcctccggtacggatacattcgccacctgctgaatcggagtcggtatcccatagtaatccaccgtcagcctgtccagaatgtgaggattcgctctcccggcacgaattgccgccaagtcgctgtccagactcttcatggtcttctgcatcttctcttcgtatacttttaattgttcatgcataaatcgttcctcctgtcctctctcttaaacagtcactttcgttcctgtaaatttcccgctcatagtattgacaatactattctcctcattcaaaccgaacaccagcatcggcatcttatgctccaggcacatgatggacgctgtcagatcgactgccatcagcttcttgtcaatgatctcctgaatggaaatctcatcgtacttcttcgcctctggattcactttcgggtcactgtcatagatgccgtcaatcgctttggcaagcagcatcgcatctgcctcaatctcaatcgctctgagtacagctccggtatctgtggagaaatacggatgtccggttcctcccgcaaagaaaataaccttgcccgtctcaagcgccttcactgctgcgtccttggaaaaaagcgttgtaaatgcaccgcaggtaaatggtgtgaacacttcggtatccatccccgcataacgaaaaatctcagaaacataaatgcagttcattaccgtggcaagcataccgatctggtctgccttcacccggtcaatcgtctcacttgtacgtcctctccagaaatttccgccgcctgtcacaatggcaatctgaataccctgatccaccagctttttcacctggcctgccacttcaaggcaagtcgcctcgtcaaagcctgtctttttatcgcctgcaagagcctctccgctcagttttagcaatactcttttcatggtatgaactccttctcccgagccgtttcccccggcccgtattctatcttttattatatctggatcactaccttgtgtcaatttgcattttccaccggaatccggacacactttaacggaacgctccgcctttttgtttttccgactattcttctgtcaatgcagcaaaggaagtatccgcaaaaaacgtgtccgcactgtacagatacagaacctcattgatttcttctgtatccatcaactcctgaatatcaccataataataccgcggatccaccactacgatctccctgtagtacggagccagaaacgggaggaaacagttggcgtaggaatccttgaatacaagcagacgcttgttttctgtcgttggtgtcttgatctttaacaagccatggtttccgccgaaaaagacttcgtacgcatttttttgatccagcttatcggtattataaaagctgcccgtctttttctgctcatccgtatattccacaatggacgaaacctgttcctgtgtcgtattttcattcttcttcggaagaaatacatctattttctctttcatacccgttcgacagccgctctttgcggaaagcgtcccctggaactgatccgtcaccgggatcttttcatatgtcagagcggacgtgtcaagctcggcaagctcggcaaatttctggaatgcaagatatgcagcggacgtcgtccagtggtgatccgtcttataatatagctgctgttccgtgtttttccgaaacgtactttctacgtccactgtcgtcaatcctgcccctgtcagtgtctggtatgcctgatcgatataggaaccctgatccgctgtcagagccaaagccggaagcttgtcctttaaaatctcggaagctgtcggaacaatcattacataatggtggatgtccttataagacttctgaaatttctccattgctttcaatgtctggttcactaccgactgctgcggacggtcaaatttttcaatcagatagccgctctttccgatataaactccgttttcttctactttcccgagaagacggtcaaatccagtcttcaatttgatccaggaatcccgaaacacaaactgatcgttaaagtattcctgatattgctgtgcataacttccattccccacggcttctgctgtcagctccggcttctgcgccagctctctgttctccgtctccgaaatcttcttcgtcccggaaaagagattgacaagggaaagaataagaaccaaaatggcaaacataaatcccacaaaatatgcagttggaaatgctggtttcttcatgtctgacacctcccttaaaactgcatgtacaggaacggctggtaggaattaaataccagtcctccaatactgagtaaaaataaaatcagatatacaacaaccgtggtgattgcggaagactccacaaaccgctcggaaaactttttcaaaaccggtctcgctgaaagaatacagactgcaaacaggagaaatcctgtctttaaatagtagcctgctgtcaggtcaatgaaagaagaggcaccaaatccaagtaatgctccaaggattttgcccactgcatccagggatgagttcataaaaatcaaccatccgaacattacaagaagcatggtatatagattggccgcccatcccggaagtcttgaaagcaggttcttccatacatatttctcaaaaatcagaatgacaccgtaataaagtccccagagcggaaaattaaacgttccaccgtgccagattcctgtcagacaccaaacaatcagaatatttctgagatgtccgggaacagatacacggttccccccaagcggaatataaacataatcccggaaccatgaactcaacgacatgtgccaccttctccagaactctgtcacactttttgcaatatacggataatcaaagttctcctgaaaatcaaatccaagcatcttgccgaccccgattgccatatccgagtaaccggaaaaatcgaagaaaatctgcatcgtataggcaaacagataaatccaagccgtcatcatagacatcggcgtccctgcatcctgaatctgagaaatcatcatagagagttgatctgccaggagcaccttctttgccagtcccagaataaaacgcctcgctccttctccaagtctggacatgtagacattgtgtgtatataaatcttcccgaatatccgcataccggacaatcggccctgcggacatacaggcaaacaacgacgcataagcaagaaacgcaatcggatccctctccggctcacatttcttcttgtaaacatcaataatataagaaagattcttaaaggaatagaacgaaagaccgatcggcagcgacaaagcggacgtagaaaatccggttccaagccactcattgacagccccgcttaaaaaaccatagtacttaaagaatcccagaataaacacgtctatcacgacaacgaatacaagggatggaaccgcactttggttcctctttctctttcttccgatatcgatacccatcatataatgcagtaccgcgctaaacagcatgagcaccacatatactggctcaccccaggcatagaaaaaaatactggaaagggcaagcacgacatttttccatttcccaggtacaacataaaacaaaatcaaaacgaccggaagaaacgcaaatataaaattcagactgtttaaaagcatgtcattttccctccaccaattattttatcgcactttcaaaagcggctttccagtcgtccgccctgtctccagccatatagatcacatagactccctccgtctgtgcgtacgccttcttcaactgtgcgctctgcgtgaccccatatccttcaaaactctccagttgattatccaggcgggtatccacagcctccccgaactgctcggcatcatgggcactcttggctttcagaacaaggagctcatccactgccatcggtgactccgctttataatagaaatatccatcacactccttaccatctattccaaagtatctccgcagatccttgtcttttccctcatccattccatccagaagctttgcactttcaaactccttgtgcattgcgccaatggatacgtcctttgcgtatcccctcatacagagaattcccagatatacaagaagaaatgcggcaaagcagactttgataatcatcccgttccaatctcttcttttctttttcataagttaaagccccgccttttctacaatataagatagccactgttcatagtaggcctttttcatatggattccgtcctgctcataaaggctactgtcagcctctacaatgaaacaactgtcgatgtaaagatatccctcatcttcacacatcttctgaattgcctcattatactgcggctgcttctcgcggccggctttttcctttatgcttgcttccgtcatcggaagaatggaattcacacagatcatcgtatccggaagcgcgtccttaatcttccggatctgagacttatatttttcaataaatccatcgatgtcggaattatacatctgcaaatcattgcagccaaactccataatgacagtagacggtttcatagagatgactttttcgatcagctcatcaatcccgttgacagaagctccacgcttataaacaacagatcctgcatccagtatcccatacacatccagtgcctcagagaaagaatctcccacgaccagaacaccttcaaaggccttcttgagcgtcgcactgtcaagctccacaactccatattgatttcgcttagatgcatcaatctccgtcttttgatttgctccttccagagcctcccattgcttctctgtatcggagatatctacttgctccagtttttccagttgcttacgattcttcttatattcgtccgggcggcttttctttatctgaacacagacaatgatcccgattataatggcaatcacacaaagagccacaatcaggatccgtcgtcttaaaattttttctcttgcacttttcatgtatttatccccttagtattgtcgtaaactctatttgtattataagaggtttctccctctttcgcaacacaaggattggaaataacgctccagcgcttccagattctcatccgagtgttcgatctccctggcgtagcgccaactagactcccagacatccgctttttctaatcttcccccctgtcgaagccatcttgccatacacaggtcataaatcatagcagtactatagataccaaagctgactttcgtatcgatcctaccgtcataaactgctccgcaaaaataggtatagaagaaaaacatcatcaaattctccccgtactgttcccacttcttaaacagaaaagattccgcaatcttccggtaggatgcctctccatccttatagagaatttcagccactttagaaagctcgtcttcccagctctgatgcagaaattccatccgaagaagctcgtccaaaaaccttgtcctttctatgaattccagactgtctcctgaacaggcggcactttgaatctctgcaagtctcccatcaaccgcaaacagatttccctcctccagcgccctctggcatacctgccccgctatcagacatcgttccatgcggacagaaacaggctccttccggttctgtacggtcgcgaacagccaatcccggatctcgtttaatatcgaatacatcaggaagtcaaagttctcatccggttccggctccttctcttttgtctcttcgcttaggaagataagcggctccgtacattccaaaataatcctggccgcttccggacaagaaagggacagggaaatctccctcacattctcaaactcctccgtatgtcttggatactcccgacaggttcggcaaagaaactcctctcccatctcctcgtagagatcacagagcttctcctcattcaggaagctgcacctcctgtcaaactgcaagaacgcgccctcctcccagtcaatggatgtcaacatccggtttccaaatccaccctcgatgctgctgtacttttcaagagattcctcatcaatcagaatctgccatccagcgcagcaggtgtccgggcatcggtctgcaatacagtgaaattgatcgtaaaaatgtggcttgatataaagcatacgttcccctctttttactttattcgacatttatttatcttaccggatttctgacccattgtaaagctttgacaggaaaaaccgggtgcaacttttgtcacacccggtaacttcaaatcgttctctatgcctgcggtcctgcactgacaagtgcttttcccgcttcgtttccttcgtatttctggaaattttggataaatctctgtgcaagatcctttgcctttgtctcccattctgaaacatctgcataggtatctctcggatccaaaatattggtatctacacccggaagctctgtcggtacttcaatattaaagtacggaatcttctttgtcggtgcgttcagaatatcaccgtttaaaattgcgtcaatgataccacgtgtatctttaattgagatacgctttcctgtgccgttccatccggtattgacaaggtatgccttcgctccgctctgctccattctcttaacaagctcttccgcatattttgtcggatgcagctccaggaatgcctgtccgaaacatgcggaaaaggtcggcgtcggctccgtgataccacgctctgtacccgcaagctttgccgtaaatccggaaaggaagtaatactgtgtctgttccggagtcaaaatggaaaccggaggaagtacaccaaacgcatctgctgacaggaagattacttcctttgctgccggcgctgcggagaccggacgtacaatcttctcaatgtgatcgatcggataagaaacacgagtattttctgtcacactcttatccgcaaaatcaatcttaccctctgcatcaagagtaacattctcaagaagcgcatttctcttgatcgcattgtaaatatccggctcggattccttgtccagattgatgaccttcgcatagcatccaccttcaaaattgaagattccattatcatcccatccatgctcgtcgtcaccgatcaaaagacgcttaggatcagtagaaagagttgtctttcctgttccggaaagtccgaagaaaatcgctgtattttcaccattcatatctgtatttgcagaacaatgcatggaggcaattcccttaagcggcagatagtaattcatcatggagaacatcccttttttcatctctccgccgtaccatgtgttgacaataacctgctcacggcttgtgatattaaacataacggccgtctcagaattcagcccaagctctttataattttccactttcgccttggacgcattatatacgatgaaatctggctcgaactcttcaagctcctctttcgtaggctggataaacatattggtaacgaaatgtgcctgccatgcaacttccataatgaagcggatcgccatacgggtatccttgtttgctccgcagaatgcgtccacaacgtaaagcttctttccagaaagctcatccagggcaatcttctttactgtctcccacgcttcctgtgtagcaggatgattatcatttttatattcgtcagaggtccaccatactgtatctttggaattctcatcaattacaatgaacttgtctttcggggaacgcccggtgtactcaccagtcataacattgactgcgccaagctcgctcacctgtcctttttcaaacccttccagacccggttttgtctcctcttcgaatagcaattcataagaaggattatgcacaatctctgtggttccagtaatgccgtacttgcttaaattcatttctgccatcttacatcaaacctcttttctttcattttttgcgggaaatcttatccaacgactcccttttaccattatacatgataagtcaatgaaatcaactaaaaatttttctattttaacgcaggaaagcgcgttttatcgatatgcacagattttgcccgaaaaatgatttgatatttagtcatttttttaacaatccatgccatcctcctaaaattctctgctcacacactttcttctgaaatcatcttataggtgattttcctggcagatccatgcaagcaacgcttcgcagccttctcttacgtcccggtatgtagtatcaaaatcacctgtataccacggatccgcaatatcctcgcctttacgctccgtgaaatccaggagccggaatacctttctctccggatcgctgtttccgataatccgtccaatattacgaatattccaggaatccattccaatgatatagtcaaatgcatcgtaatcttctcttctcatctgacgtgcccggtgatccccacacgggatcccgacttcctttaatttatggcgagtgccgtggtgaaccggattgccaatctcctcccggctggtagcggcagaatcaatgtaaaatgaatcagttaagtttattttatgaaccatgtcctgaaaaacgtactgggacatagtactacgacaaatattgccgtggcaaatgaatagtacttttatcatgttcttagaactccttaaatcgtcatatttccttgtatttaaaggttttttacaactttcatttttcttgtagtttctgtatcttcttataaattctcatgttttggcagtcaaaagttgtaaaataagttgtaaaactacccttattttacaactttacaacttaccgattgcagacttctttcatctctttttgaatatcgtcaaagtccaagtgcgtgtatgtattcagcgtaactcctatatcagaatgtcccataatcttctgtaatgtcttagggttcattcccgactttgccatattagaacaaaaggtatgtcggcaaacatgaggtgtaattttaggtaattcctgtttatatattttattatacttctcgcaaatatgctgaaaatatttctcccaatgcaaagcaaccataggcatatcatttttgtctaaatacagaaaaccacttttaccgtctatcacaggttctgattttgactttttacggttttgaataatcttacgaaaacacgcctttacatcatcagtcataggcacaagtcttgtaccgctgtctgtctttgtgtcctctataatatattccatattacgcttacgttgcaactgatgattgacattgataacacctttttctaaatcaatatcagaaatcgtcaatccaacaaattcagaaatacgaagtcctgtcttaaatagaatgtaaatgccctcataatacttacgaaagtgcttgtcctgctttacaaattcaagaaacgctctctcctgctttcttgtaatagcttctcttgttacgctgtcattgacaaccaccgttgcaagctgaaattcaaaagggttctttcgtatcaaatcatcatcaacagccatttgaaacgctggtcttacaacaccacggatagaatgaatactgctgtaccctctaccgtctgcctgcaatttaatgagccagccttttgcgtctgatagttttaccttgtcaatccgtttctttccaaaggcttctttagcaatgatattgataacaaatttatagtttgcttctgtattatgccttacgcctgttttctgtgaaatatattttttcacaagctccaagactgtcatatctccacccgaagaaacaatatcatcttctaaatctttatgtatctgtttctccttatcccgtaagggaatatcatcttttgctccttgtggaatggtatcggtttttaccaatttccaactatacacatatttcacatttccagcattatctacatacttatacatatatcttccgtctttacgttgactctctccattgcgtaaaacacggtttttattgtcccgtcttttttcgctcatcttcgctcctttccacttctgaaagagtcccgatatgacttattctcatcataacatataccagctcctttttcactagattgcgtccaatttatcaatgaccttttcaaactgtcggcgtttaatctgtatgcggttgccattcataatgagccagccagcgtccttgttttcctctgctaatcgtcttagcttgttttctccgatacggaaatactttgacgcttcttcaatggtaagggtgtatttttcccatacgggaatatcctgtgcattactcataaaacaccccctcactttcgattacgtctgctatgtccgtacacatctgctccacaagcatttcctgtttttcggaaaggtgggtacattcatcaatcattttcatatagtttgaacctgtcagcctgtcgatttcttctatcatcacaatggacggcatgacctgtctttccagccattgcagagtgcgttccatattgacaggtacagggttcatttcaaaaggtaaattatcatgggaaatgaatatctcccacaatggatagtcgggaaattccacaaaatcggtaatgaggtaaaacaccagcccatgagggttatacgtcaataacagttcttcaactgcctgtactgcctttttgtcacgcagacgaatttcaaaacggttgataatatccgtatgtttctttttcgttgcctgttccttttgtttttcatacaggcagaaatattttgtgcttgcctttgagccgatataaagagtgcttgctaaattacggttttttccgcttagttttccaccctgcacattttcatagtttttacagcgacattccgcaccgccatttctgtatttttcagataaaacaggaatatccagcagaccgcacatatcgttgattgccaagtcaaaacgtcggataacaccgccacagtcaagacagcggtttaagaatgaataccaatccctgttctgtgcctgtaagacgtattccatgttgcgtgagcctgccccttttaattccaaaaatacacccatgtgttcatcatcagaaaccataaccttgatttctccgtaggcataatgctccttatagccataatacccatattcataatggataaaataatctgctttcatgccaagcacctttcggataacttccaaagcgtcagtcgttgggaaacggacagacagataatccaccagcagataaaaaggcttctcacagacataataattcagacaacgcaggataatattttgtgtttccttactggcgttggcttttccgttctcaaaacggttgatactatatcttgatacatgggtaagacttgcaagttctccttgtgaaagaccgctggcaagacgtttgttcttcatttcaagtgcaaattctaagttgttcattgtattcctccaatcccacaatagccttgaaatacctgtaaaccgcctttcaaaaaagtgtgaagtgtactatcttcttaaaactcctcattactccgtacagctttggggttgtatggtttttgacttgtcttttgtgaaatagtgcccccctgttagataacgggggcacagacaaggctcgctggctcgccagccgacaaagcatttcttccccttgacacaaggtgtcatggcgtaagcctgagaggcttccgccaccgtgtcagaaatactttgtcagccaatcctgttttgccttttctaacaagttccattccaaccattattcatatctatgagtttaatcagacaggcatttctttttgaatgtttttgtatttcattctattgtgcttatttacttacaagaacatagtaattcttatatgcttatttgtcaatatctttttttgtctttacaaatcatattaagcatgatagacttataatagtgaagatataacgagatatggagggttatgcaatgaaaataagccatttaggaaataatatacagaccataagaaaatttaggggaatgaagcaacaggaacttgcggacaaaatcggtatcaatatgcagagcctttccaagattgaaagagggttgaactatcctgcctatgaaacgctggaaaagataatggaagtgctggacgtaacacccaatgaattgttgtcgggggaatggaaatatattaaccaatccgaaaaagaagtatgtcagtttttaagagcagaggaacgactaaatgtggaattgaagcatggacattatgataacttctttgacagcgaggaagaatggctggactatgaattagaaaagttaagggaatatattaccgactatatcaacgagaaaagtatcgaagcgtccgacctttacccaatcaaagaatttatccagcatttgaaattccaaaaactgttagaccgctatgatgatttatacagtatggatatgtttggggaaagcatagagggacataagtataaaacgccttatcaagtcgtgaaaatgataaacccaaattcaaaagaggatatggaactgttacaggaagtattaaggaataaccattttgatgatgaggacgaatagtcttgttcctcttgtatggaagatacagcaaacaaaaagcccagtaaagagtgcaaagcaccaccaatggtggcaagctcttgacaggactttttcttttctgttttgagataatcaagaggaagaaagagtaactgttatcaataacattgatagtcataaataaagaatttcattaccgcttgctgtcctttgatgttaaatatgtgttctttttctaatcgtctttccattccttgatgttcataaaaaccataattacagcttgtgtctgtaaacaaataaaattctttcagtttttcctgcttcatgtaatcgagagttgactgaaagagaattttcccaatcccttttcctctgcatgatgaacttacagcaaataaggcaagctctgctggataaattttgttgttttcattcagtaattgtttatctattccattgacgttaccaaaaatttttgaaacatttcgtccctctcttgaactgtataaggataatattgactttatctgtaacagtcgatttgaaagaggacatttatgcttagcgatattgttagccaatataatacccaccacatttctgtccattaccgctacccttgaaaaagtgtagtttgttaaacaactacttagaaatacccttgctagtttaaccgctgttttgggactgctaaaatcatcataatgccatgtttccctaatgatagtttctaaagccttaaaatcttgtttttgatattcacgtaattctatttgcattgttcttctccttgtttttatcattcatatcatgtatgataaagtatacagtaactgtaatgtcaataaggagttctaagaaaatgagaaaagaaattaaaaggctaacaactgcacaatttgcaaaattacatgaagtaaataaacgtacattacattattatgatgaaatcggtcttttccgtccacttacaaaagctgataatggctatcgctattatgatgtttcacaaagtatagattttgaatatatccgcatgttgaaagaattaaatatgagtatcgaggaaattgaaatatatcggaaaaatcctacacctgctgatttcttaaaaattatgaatgagaaagaaaaagaaattgataaacaaattcaaaagctgaaagatattaaaactgtaatgcagaataagaaagagcaaataattttttgtgaaactttacaggaacaggaaatcagaattgaagaatgcaaatcagaaagacttttagtctatccttgtgatttctcagaagatgatatatcacaaattttttctcacttgaaagatatatggggaatagaacaaatacgcatgggaatgggaagttttatttcacttgataatgtatgtaagatgaacttcgataagtacgagggaatatacacgattgccttaaacaaaaaatctgttctgaatagttttataaaaccacaagggaaatatctctgtggttatcaaaagggaaaatgggatcaattaccaaccttatatcaacagatgcttgattacacccataaaaataatatacaacttactggctatgcttatgaagtcggcttgaacgattttgttatttctaatgaagctgattatattacaaaaattatgattaagattgatgaaaattcttgactttacacttagtgtatagtttatactttttgtatcaagatataagggaggaattttgatatgaaattattactactggcagtaattgtgcttataaaagttttaataaccaacggcgtggcattagtgtgtattatattgtcattcatattcaaaggcaaacaattacataaatcagcacttgaatgggacaaatacgtcttatctctgaacaacgcttttgtatataagtacacaaaaatcatttatatattatctactgttttatcttcttgcgtgatgtttttactgcttaaatttattgatttcaaatacccaatttctttaacgctcattattttaatggtttgcagtttaattacatggtacagatatcaaaaaagtggtaaaagttacataaagacaaaattttatgagattaaagagtcaatactgtctgatagtgtaaataatgacgttactccttaaaagttccacataaaattgaatatataaatatcttagctcgtacaagcattgtgttttgtacgggctttttcttgctctcttttccgtattttcaaaggtatagacggtatttccgtttatatatttcaacgtatgcgaaaaaggtgaaattatggactcatcttcttacgagcatatcattagaatacagtttaatgctttgatgatgacagttattaaatgcacagtaaaaagcagaaacagacagtttgcaagacgttctaagcgtgaaattttattctgtgaattatcagatatgagaaatcttgagagtggaacaaaagataactattcttgtgattatatttcttttgaagtcgtgaattacacaattcaagtatcaaatgagaaacttgctgttgctttatataagttatctagtaaagagcgtgatgtaattctattacgctattttcaaggcatgagcgaccaagaaatagcagaattatatcatgtatcacgttctgctatttatcgcagaagaagtaacggattgaagaagttaaaaacagtattgaaagaaaggaattgaaccaatgaaaaaagaatatggctaccctatattaaaagtaatatgtcaagcgtctgctggaaatgaaactgccataagagagattttgaagttttatgacgcttatatctgtaaattatgtttgcgtccgttttactactctgaaagtggtaaaatcattatgcaggttgatgaagaattaaaaggtcaaattcatacagaaatgatgaaagcaatcttgaaatttgaaatcagagtgaagtaatcataattaaaaaataagaaaatgggggatacacggtattgtgctatctcccatttcagtcatatcggaatacttttcaaaagttgtaaaatcgttgtaatgccctctcccactatgaaataaccgcataaaataaggagatttaggtaaaagagaaactcctgccgtggcagatgaatagtattttaatcatatctcaaaaactccttatatttgctgtatttccttgatttatcggcttttcctgtcgtctattggtatcctctgttcttggcatatcttttacctcaaaagtagtaaattaagagagattatgccattttactactcgacttttgtcatccgttccaactcctctttcgcatcatcgtaaccgatgtgcgtataggtattcattgtcactccaatatcagaatgtcccataaggtattggagcgttttcggattcataccgctttttgccatgttaaaacaaaatgtatgcctacatacatgaggtgtaactttaagcatctgcactttgtagatactgttgtacttcttgcaaatatgttgaaagtatttctcccaatgcagagctaccatcggcatatcatttttatccagatacaggaatccacatttaccatctatcataggctcagttttcactttcttcctgttttcgataattcgctgaaaacaagcatatacctcgtctgacataggaatttctcttgtaccgcttgtggtctttgtgttctcaatcacatactccatattcctttttctctgtaattgatggttgacattgatttttctattctgcatatcaatgtcattcagcgttaatcctacaaattcagaaatccgaagccctgtttaaaataaaatatagattccatcatagtatctgcaaaaatgcttgtcctgtgctacaaattcaaggaaagctcgctcctgttttcttgtaatagcttctcttgtcacgctgtcattcacgacaacggtggcaagctgaaactcaaacggattcttgcgtatcaaatcatcgtcaactgccatctggaatgcaggtcttataacaccccttatagaatgaatggaactgtaacctctcccatctcgctgcattttgataagccagcattttgcgtccgacagtttcaccttgtcgattcgcttcttaccaaacacttctttttttataatattaactacaaatttatagttggcttctgtattgtgccgcacgcctgttttctgtaagaaatactttttcaccagttccagaacggtcatttctccaccacggggaactatctcatcatcaatatctttcaatatcagtttttctttctctcttaatgaaatatcatccctttttccctgtggtgtcttatccgtcttttccagtttccaactgtacacaaactgctgttttcctgtggcatcaatgtatttgaatgcgtatcgtccgtcttgacgttggctctctccgttgcggagaatacgatttttgctgtcccttctttttccgctcatattcatgctcctttcatacaaaaagagccccgtcacgatatagcgtagtatatcataggcgaagccctttttccatcttaaaaataaaagtaacatttaaaataaagtatcctttgtattcatccgcaaggctacctgcattgtaatttattcaaaaatattcaaatagccgttaaaccctctaaaaaacttcaaactgttttctcttgattaaaaacttcaccccattctgaataataaatcctgtatctatattatctgcaacaatctttcttaatttcttttctcctaatattaaaatagacagatgcctcatcaatcgtaagacagaatttatcttttatttcaacctgtgtctgctctatcattgcttttccttcataaatttaaagcagattactatgggaaattttaatactaatgacaagagccttatcaacccttgccattgcattgtcaggtattttacctatctaattcctaagtcgctgtttatcaattgttcgtatctgttcaagtagaataacagaatccctgtcaagtccttcaacattttttacttcagtatgtgttggtaattttgcttttgtctgtgttttccccgtaattgccgccacaataaccgtagggctgtgtttattgcctatgtcgtttgaaatgataagtacaggtcgtttacctccttgctccgaaccgataacgggatttaagtctgcgtagtaaatatcgccacgcttaatcgttttttccattgtgtttgacctcctatctgaatttaggcaggagtgttccacctatgtaggcagccaaacacaaggaagtatttaggtcgggagagcataaaacaaaactctgtttccataagtcgccttgtgtttggctttatgatagaagcatctctatttgtcctcgacaccccgaagatgcaatgcgttgtatcacgcagggaagtcaccaaacggtcagcagcgaactgacgccacgggagtttcacccccaactgtctcgttctgacagagccgccctcattgcctgcggtggactggctaccactcggactgtgactggacgggagtatcattatcctctttgtgggttacggcgaaatcgggagctgcccgatattttgagtcggtaacgaatggctcaccacctttcatatcgctcactgctttttagcaagtcttggcgtaccgctgcacacgcttatgctcatcacaatcacaaagagaaaatatttggcgaatgattattcggttgtcaaggagccatcccgttttcgccacacaaaggaaaacaggtgaagggggagtgatgccccttcacctgtttgctcactaaaaaagaattcgtgtagtgtaaaatttaaaaagtcccaaaatcttttttcaacttctcaatagcaatatcaacactaaatttgactgctcttttcgtacagccctctatggctgcaatttgctcataggtcatttcaccgaaaaagtacagtaacaatctacgccgttgtacttcgggcagtttttcgattactctatgtaacaactcgtattccatatttcttgatacttcttcctcaatactttctggcttgcagaacgcacgttcattcaatgacgcttctgtcagctccgaatgttcaatatgcctacttagcttgttgaaatatgatatatcctcaagctcaaagcgattaaacaactcatacagtacttcatcaatctcaatgctctgcaatgcacctcgactgtccttaaacgagaggtaataacgcccgtctaaaataatcaatgtatatggattgtacttgtcctttttacgattttgatgcttttcatccattgtctgttcctcctatcaatctgaaatttgaaaaatccagattgatagggcggcgaacggcaaccaacgccagaagctgacttattctgcgttccagtaaaaaaggcacaaaaaaatccgcaaagattttgtaatctaagcggatataagaatattcaattctataatatagaaatataacctctatttttcggctatacgagtaccgtaagcacgcaaggatttttttaacgagatgtccttgcagattgctgaagtattatatgtaattgccgcttctgataagcagcagtgccgtcatttcagaccaacacataaaaaccctccaaaccttaaacgggtttagagggtcaaattttcatctgagcgtaacaaaacagcccacccaaaacaccgtttttttattaggtgggctatcttacctacagattctctttcaaaatacgaattttaatctatattttcttttctacatttataaccttttgaacccaatcacgataaaacgcttcttcatgtgatactaatattactgtaccttcaaattctaaaagtgcagttcttaacgcctccttcgccagtgtatcaagatgatttgtcggctcatccataattaggaagttacatggtttcatcataagcaaacatattttaacttttgcctgttcaccaccacttaaagtactaatttcctgcatagcatgtttgcttgaaataccacaacctgcaaggcgctttcttacatcttttataacaagtgatggataagcatcagaaacaatttgtatcggtgttttcgtagtatctgaccatgttaaatcttgttcaaaataccctatctttacttgctccgaaaaatgaaaattacctcctaacgatggaatttgatttacaagagttttaaacattgtagacttccctataccattaaatcccgtaataacaactttttctccaccttttacggaaaaattgatatcagacaagacagaataatgataaccaacatccagatgtttcacccttaaatgctccgttgtagttaggggagcggcaggaaatttgaaatgtggcttgatttctttttgttcaatcgcttccatcttgtccatactgtctaatgtaatcttctcgaagtaacgctttttttcttctaaactcataatatgttccaaaatattttgtaattttctgattatcaatgtcacaaatccttgtggatattttttctaaaaactcataatcatgtgaaactaccataaaggcattttgcaaacttgagagatactctgcaagccatacaacatgttccttatctaagaagtttgttggttcatccagaagcaaaatgtctggtttttctaataataattttgctaatatgacctttgctctctgcccgccactcatctgctctataggtctatccagtccaatagccattaagcccaatcctgtcgtcacttgttctatctttgtatcaatcaaataaaattcattacgttctaactcctcctgataccttgcagccatatctaattttgacatattcccatctacagactgacaatacaactgattcatcctattttccatctcatataattcagaaaatgctgattgcagaaataccctcataattgtacttttttcaatttgagcatattggtcgagatatcctatttttgtgtttggttgccatactatcctgccagaatcagggataagttgctctgtacaaaattttataaatgtactttttcctgctccattttgaccgacaatccctatatgttcccctttatttaatgaaaaatctgcatttttaaacagataattatcaccaaaagaatgtgttaatcctgtaacttctaactaaactcataaataaaacctctcttttttacatctaattttctaaaataggcaaaaaaatagcagaagttagatactcatagtatcagtccttctgctatatacatttcattataaacttcttaaatgaaataacccatatacaacaaaaggctacagacaaaacattgcccatagcctgctgcacaaaaatttgtacgagaaaagaaacaatatatgaaagaaaaagctctcatgtattgctacgtttcccgatgaaatctttacgtgttatattatgctatactctgcacaatgtttcatcggatttgattgtacagagctgattttctttttaggtggtagttcattcgttatataaaaactcataaaaccattctccttcaagttatgattttttagaataccacaaaatcagccctttgtcaaatcagctttttattaagtttttagtcttttgcttaaaaaatttgttattgcaaaaagagaggttttatatgcaataaaaaccaacatataaaaaagtaagccgacaaactgtgattgctcacaagttcatcggctctgcgtctaaagcgtctggctctttgataacgactatatgtaaattttttgcattgattaaagtttcctgtttgcatttggggcagtaaagaggatagttcttcaaaattgtatcctctctcagtctgtcacgggttttgctcccacagataggacatcgtatccaatcaacgcttatttctctcacttcgctgctttgtacagtaagcctcgattgccttactaaaaaacattgctaaattttcaccgccaaaacgattgataaactctgaaaatctttcgtcagtaatatataaatttcctaaataggagagcatctgactatcgcattgataaaaatgctcggatatatattcttgccatttctgcacaatctgttgaacctctgaacagcttggagtctttccctcatacgttgctaatttttcaaagagttcctgtgccgtacaatagaatgagcttatctgctcattttgtattttgcgactttgtgatgagaagatttcctcaaattgtctaaagctttccgtattgccccaacgctcgatgatttcatctcgaaattgtgtttgcagttcaatcactttagattgcgaaaaagcagtaaaagcaagttttttttctccattgatttcattttttataagagcaataattgcgtcaatacgctctttctgtgcctctaaaatggaaagatgtctttctaaggcttcgctgcgattataatgtggggcatctaacagtttttttatttcttttaacgcaaacccaacttcccgaaaaaacaatatttcttgtagtctaattaaatcttcctcggtatataatctatatcttgcttctgtaacaatcgaaggttttaaaagccctatctcatcatagtaatgaagtgttcttgcagtaattcctgtcaaatttacgacttcgtgtactgtcataggttttttattcattccaaaaatcctccgtggctttcaaaatctcatttgcaggcaataatgttgcttctacaatacttttccctgtttttttcaaatagtgttttactaagtgatacccacaagcatatccggcacaatagggcagtccaacagcaggataattttgtaatgctgccatttcatcaccatacaaataagcattaagcttttcaagtccttgtacgctcaagccatcaaagataattggtttaatatattcgtttaaggtttgcatatcggtttttgtaacccacgggcctgctttatcctccccatacaaatgcgttgcaaaattttcggcaagtccctcgctgaccatcatttcaccaagagtaatatcgtttttccactttataaattggaaacgcacattgtgattgacttcatgggcaagtgcaacatgtaaatgcgttaatgtgtattcattaggaataagccaagaaaaaatatatccaggtattcctccatcaccacaatacccctcattcattttgatataaggactttcagaattcgctaataaaatggtgaatagataatctttgacaggcaattgtattcctttatcaataaaacagtttaaagagttttctattgatagcttacaatcactccagagctcatttgacgataatgcctcgatattggctcgttgactctcatcaacttttgtaggagcaatgtgaccaagcatacagcttgccattataacatcatatccattaggagtagtagctttcatcggtacgctgtaacatgcccactttttttcaaaaggcatcatcatttcataacggtaaatatcatttttcttttcagacggtgctttcattatttttttgtaaattccgtctgagcgaattggaattactttcattttctctcttcctttctcgtttttctaaatcttacactatgacgcaacgtgaaagtcaagagaacaagtaaatatttttatggcaggtcaattaaaaatcttattgatactgtgcctttgcgtctggctctttgatgacggttatctgcaattgttttgcgtttatcaaagtttcctgtttacatttcgggcagtaaagaggatagtttttcaaaactgtatcttgtctaagtctatcacgagttttactgccacaaacaggacatataatccattgagattcatccattttattcactccagcgattttcttaaagaagcaatccattcttctatcacccctgccagtatatattgctgttgtaaaactgccataccagtagtcggaatgtcatcatcactttttttcaaagcgatattttcttccagatatgtttttaaaactgccatactgctttcaatattatccagacattcttgttgtctttcttttggcatactgtccaaatttacgataacagcattaaagtctaaaaaaatgttgataggcttacaagatatttcaatcatcagtttctcaaactgctgttttcctttttccgtcaaagtataaactgacttttctggcattttaccttctttttcaatatgacttgaaatgtatcctttttcctccaactgaataacctttttataaatagaaggggtgctgatttttacccactttgaaatattacggtactctaccaacttttgaatgtcatatgcactcaagggttctttctttaatattcccaaaacaatcaggtcaatggtcgccatatcatcttcctcctttactctcttgacaactactataaattatagtagaatacctcttgcgtttcaattactgtaatttatagtagtatattttatttcattagtcaagtgaaaggagaaacagtacaatggacaagcaaaacaaaaaactggagttactgggcaatgctccaattccaaaagcccttttagctatgggtattcctacaatgattggtatgcttatcaatgctttatacaatcttgttgatgcctattttgtcggtgggttgggggaaagccaaatggctgctatctcggtagtatacccactcggtcaagtagttgtcggcttaggattacttttcggtaacggagcagcatcttatatttcccgattattagggcaaaggaacagagaacaagcaaacagggttgcaagcactgcactgtacagcagccttgttgtaggcacaattatgatagttctctcaatcatctttttggaacccattttaaaactgttgggtgcaacagaaagtattcttccttatgctgccacctatgcgggtatttatatcatttcctgtattttcaatgtttttaatgtaacaatgaataatatcgtaacaagtgagggggcagcgaaaactacaatgtgcgctttgctgttaggggctgttctcaatatagggttagaccctttatttatatatacttttcatttagatgttgcaggagcagctattgcaacagcaatctctcagatagtatcgactatggtgtatttgctttatatcttcagaaggaaaagtgcttttcaattcaagataaaagactgcactttttctaaggaagttctttctgaaatttttaaaatcggcatttcgacacttgtatttcagctattgacaagtatttctatttccttgataaataacgcagcaggtaattacagcgatgcagccatagcaggaatgggagttgtaactcgtcttatatctatgggcagcttaacagtatttggtttcatcaaaggatttcagcccattgcaggatatagttatggtgcaaagaaatttgaccgtctgcgtaccgcaatcaaaacctctgttttatggtcaaccattttctgtgtaattgtaggtttattgttcagcctgttttctgcaactattgtttcacagtttacaactggaaatgtagagatgattaaaatcggagcttcctcattaagaataaatggtattacctttatgctgtttggattctatacggtatattcctctttattccttgctcttggaaaaggaaaagagggatttattcttggagcttgccgacaaggtatctgctttattcctgttatcttaatcttaccctttgtatggggattaaatggtattttgtacgcacagccgattgctgatgtcctctccgcacttatcacggtatttatggcaatccctttgcacaaaagcctgactgttgaagagcgaataatgaaaggaacatcttctatctcctgtgatgaacaatcgcactaaacatactattacaagcagagccgatgagctgtgggataacccacaagtccatcggctctgcgtctatgcgtctggctctttaatgacagctatgtgcaatcttttgcgttaattaaagtttcctgcttacatttcggacagtaaagaggatagtttatcaaaactgtatcctctctaagtctgtcacgagttttacctccacaaacagggcataagacccattcgctttttgctatcatacacttatttcttctcccatcttttcaatctccttctgcaaattcttcagaaatttgcctgcgtgtgcaccatccatttgcgtatgatggaattgaaaagagattgataaaagagccttatcgccatcaatgcgatacttcccccatatcataaaaggattgttgaaaattccgctattcatacccacagcaccgtccagttctacatttacaatagcagaagtacctataaccatatatttttccgataggtcgtggtcaatacaagtgttgtgtactgctgttgtatatttcaggtaatctgcattgaacttttcaagactgtccgtatatgcaatatcacaggaactaacttcaccatctttgttcgcaacaatagtgttgacagcaagtttatcatattgcattagcttatttcctacaggcaataaataaaattcttttacagaagcagcagcttttcctatacaaaagtcaagaagcatattgaatttcataccacgatttttacttactttaatcaatggcattacatcgtatgtcttgaaaaaagtgaccataggattaggagctttcatccaaagctcaaacgccgatgctcttgcagtttctttgggattgatttctcttacgcacattgttattacctcacactatttgcaaatcagatttctgttttatttgaactcagtcgtttatcatttgtttctgaacattttgcagtaagcacaaagcgttgtgtaggataaccaaattctattagaagttctcgttctgcaaaaccaagtttttgtagttctttacggtatcctgtatcggctctatcacccttcctataagttgttatacaaatatcttgttctggataataatcttctattaacgcatccagaaaaaatttttgaatgcctcttttgcgatattgaggatgtatacccaaaaactcaatgcagcatggtggaatgctgaaagccagagcaccaattaacaaatccccatctttcaaaaccaatgcctgtttgttttggatacatatttttaatttatgtaagtagtctgtttcatctaaaacagggtatccatcaaccactaatcgaagtagctccatccaagaaggaatatcctctatcgtagcaaaccgtatattgttctttgtcaatgtagtatttacctttttattatgtataacaacctgcaacaacaatggataaaactcttgtttatcacgatactgtgcaggtgaggtcttatacatagctgtaaaagcagtagtaaaagattgttgactttcatatccacagataaaagcaatttcaatgattggtttatctgaaaacaccaataactttgccgcttccgtgagttgccttcgttgcacataatcgtgaattgtcagaccgactgtttcggtgaacattcgatgtaaatgatattttgagtaattgaccgtcgtagaaactgtttcaaggtcaatcttttcgctaagatgattttcgatgtaatcaataacctgttcaatactaataactgcattattttccatacaaaacgcctcctttcttacaattatagtagcaaaaaaatttgcccgtgttttcacaattcttgctatcttttagagatgtccttttagccttaccgttcacttccatttgcttatttttcgctgtttatataccgtaatgtcatttttgacattagcttgcccatcttgattggaaaaagatagcaggcaatcgtctggattttttgcacgaaaccatggcaaataataaatcttttagatgtgatatgctttgcaagtccatatcctactttttgtgggtcagccataaattcttttggaacaggtaacggctctgccgactttgttcgagttaatggcgggtgaataatatggaaggtaacaccgacagaagcatattctaaattaaggcactttgccaatgcttccaatgcgcctttagtcgaagcatagggagatattcctataaaacctgttactcctacaccagagcttgtaaaaatgacttttccgtatttttgtgcctgcatatacggcaatacactttttactaaacgaagtgcgccataataattcacatcaaaagaccgttcatatatattgaaatcagtagtcgtttctttaccaaaggtacaaaggcaggcattatgaatagcaatatctattcgttgaaattttttaataatatctgcaatggcgatgcgtatctgcatctcatcacatacatctgccttataatagaaaagtttattcggaaataactgtgccaatctttcaaggctttctgtatcaacatctaacacagctactttgtttccatcctttagagcctgctccataaaataatatccaattccttgatttgcaccagtaattacaatgttagacattatgccacctccatctctgcaaaaaatttctcgatatgttgataagcagcattccgaaaagaatttttttgttcttccgataattctccgctgaataaccatctttgagcaaaaaaataaatgggtgcatagtatttaacagctagatatccactatctgattttggaattattcctatttccattagcgtaccaaaaaccttactttgaaattcaagtggctctgcaaccatccaacggtcatatatcttttggacttccgaattaccaaattgctcaatcagaagaagcctcattattttgttgcaaaaatcgtccataaaatagctttcaaaaaaggtatcgcaaacagtttggtaaaatggcttctccattgaacaggattgcactgacaaagattgttctaaccgtaccatcatatcggtcgccacttgctcaaagtgataaagcaactcatcaaaaatagcttgtttatttttaaaatgataatagacagaactttctttaatcattacctgagcacaaatatctctaatagaaactgctgaaaatccctttcgagaaaagaggtctaaagatacatctaatattttctgctttgtattactcatcatttacgccaacctttctaacgactgttagataaattatacctaacaatcgttagaaagtcaatgctactgaaatagggataggtaatttaatagaaaacgcagaataaatgactgtgattgcttacaagttcatcggctctgcgtctgtgcgtctggctctttgatgacagacatattaaattgttttatactaatcaaaacttcttgtttgcatttcggacaaaataaaggaaaatttttcaattctgtatcttcacgaattttcaaccttgttttatttccacatattggacatagtaaccattcttctttttgcacaacaccacttccattcttcgtaactacttcaggcttttttctgctaatgctttaatttcttcttcaagtattttgggttcagtaaatccctcattaaatccgtctatttttttcaatgactgaaacaatcttctataaagaaaattcatcttatcatagttcatttccccacctatacaagttacataaaatgcgtgatttaacaattctaatggaaatagtgtttcaaaaaatccatttattccattcggagtatagcaacatacaaataatcctactcgctttttcaatagctgctttaagttatgtttacaaaaacgagttatttctttttgaatttttcccatatagaccgaaccacctattaaaatggtatcatattgtgatacatcaattttggaatttttagcagaaaatacttttacgtcactttgtaaataagattttaagatttccacacacttttttgtgcagccatatttagtggcataaatgattgcaattttcattttatttcccccctcacgataaatcttgtcaaactgttcaatatgttttcccaaaatttttattgcctccgcttccttctcggcaataccgtcatatctgttcagcaaaagaaaaatgggagcgaaaaattgtaatgccataattttagggtctgctttccgcatataaccttgctttatcatttcttcaaaaatttgagcttgattagaaatcgcagtatcaatatacacttcccgatagatacggtctatttccttacttttatatttttcaatagaaagcatctttcggaattgagaagcataggggtcttttaagtaaacaggctatcaaaaaggctcgattggcaaaagggatgaccagagatgactttttcaaatattagttcaatttcttccatgatagattggctgtcatttttcatacataatagcatagccaagcaagcttgcatatctgacatattatctaaattaaaagaagattttccattttcaatatccggaaaatgctttaaaataatttgacgtatttgctccaattcttccttaaaacattcccaaggggtactaaacaccctggccctataataaacttcatcagcatgtatttcatgaactgcatatttctgtattcttttcaattcatctaatatctgacttttaggaaaataccgattattatatttaatttctgtttcaaattctctccattgtctttctgtttggtgaaacaggaaaagtaaaagcatcatccacttattattttcatccataaatttactgttctctcctcatccattgctttccttagtatatcaaaatattccctcttttactagcttctacatgctagattataagaaaaacgccctgccaaagcagagcgccttcatcctttccatattatactatccgaaacattttctgtgaaactgtcccttctccatttatcttttacatttccttcctggcattctccagttcttccacccgctttaactcatatacggcgtcctccagccccagatgggtataggtgttcagcgttactccgatatcgctatgccccatcagatactggagcgtctttggattcatacctgacttcgccatattactgcagtaagtatggcggcagacatggggtgtaatattcggcatctgaacccggtaaatggcgttgtatcgttttaccatatggttaaaccgatgctcccaatgcattgccaccaggggaagcccctctttatctgtaaacaggaatcctgtgtattcgtccaccactctctcataccttggtgcttcccggtcctcgatgatggcctggaaacaccggaatacgtcttcggacatcggcagcttcctggttccagcattggttttcgttgactcgataaccagccacatatcagaagttgtcgcctactaccaccgcagcaaactcaaaacatctgcgccaatccgtcaatgatgctgtttcttcgcccgctgatacttaaactccagttgttcaccaaatacagcctaaaagtaagtaatcgtagccgtattcgccaaagttttctcgcattattttacaaaaaggggaatccctatttaattttctatttttgttcatttgttcccatgcttatcatttcactgtttcttactaaaaattttgaactcccctttctatattttttcgaaaataggttgaatttatcctattattggatataataaaagtaaatagcaaaggaggtctcgttatgaatatcaacacaaaaaatctagtttccatcactgatgccaatcaaaatttctctaaagtagcccgcctcgtagatgagaacggttctgttatcatattaaaaaacaacgtcccccgatatctagtcatggaattcagttctgctgaagaagaacaacttgccgccgatgaagatgtcatgtctatttccaaacgtctcattgaaaagaaccggcaggcttacgaggtacttgccaaatgatccgattatccaagccacagatacttttgctgcatgaacaactcattgcagaaaccggagggtcatcgggcctgcgcgatgaaggaatgctggactctgcactgaatacccccttccaaacctttgctggaaaagatgtctacccatcactccagcaaaaggtagcccgtctttgctttggcctggtaaaaaatcatccctttgtagacgggaacaaacgtatcggcgcacatgttatgctggtgttcctcgccttaaatgggatcgaattacagcatacgcagacagaactgtccgaggtcatcctgcaattagcggcaggcacccttcaatccactgatttactggactggatactctcacatcagatatagtaacaagcgatgatactcttttttaagaatatcatcgctttattgtatcatctataaaaacttgtcacatcaaggctctttcgaaaatggtgtagtagtggtgtagtaagcgcctttctgtttcgtaaacccattgattttactggcttttccgggacttttcaagatactgccgtggcagatgaataatacttttatcatgttcgcatttctccttatatgttggtttttttctgagaaattatatacttcatttcgctatgttacactgaactacattttttacaatttaccgaaagcattataatgtaaactctatgattacttttccttttcatatacaattttacactgttggcaaactttctttgttagtaacagattccatgcatgcattctactatgccagcgtttattcttcagaaatgtattccaatccatttctaatactgtttgtaactcatagttatcatcaaacttacatacaataacatactcaaacttctgattatctggtatatttgattctggttcttctaatccataaaacacacttgttgtattgctactcgttgattttatactgtatctatcaccttttctgctaatcgcatcaatattttctgttcctactggtgcgggtgaaagattaggcaaaccaggtgtattattatatagttctattgccaaatattcgccaagttctccaactacattatttgttctaataaccccacggtgttttaattcttttatggccatactatacagttgaattatttctttagtttctttttcttgcaaattaatcattttatcctctgttccttttaatattcaatctttaccatattctcttttcaaaatgactatctattctaaaatctattctttattctcatgtaaagttggatgttgcatgtaaaagatttttttctgccgttcaatttctgtttttaactgctcttttgtaggcagataagtcaaatattttgacataaacagtcggtcgttgtcatgaagtaccgaatatctggcaatatcctcatctgtttctgaacacagcagaatcccaatggtagggttatctccctgccctcgctttaaatcatcatacatacgcacatacatatcaatctgtcctacgtcttgatgagtaattttgcccatcttcaaatcgattaggacataacacttaagttcaatattataaaaaacgagatcaagatagtaatccgaggtttccgttacaatgtgctgttgacgagccacaaaggcaaatcctctccccagttccatcaaaaaatctctaatatgtgaaagaatggaggactctaaatctccctctaaataggtatcttcatttttaaaaccgagaaattccgcaatcattggacttttaatcaattcaaattgatttttctgaaattccgcagttttctgtttcatttcttcaattacagcctcttttttcggcgtctgaagaagtctgtaataatattgcgtactaatattacggtctaacgttcttgagctccaactctcgtcaaccgcctctttcatataccaatagcgtgcattttcatctgtaacacgaagaagactcctaatatgcgtccagttaagattgtgaacgcatgcgttcataatctgctcatcgggaaaacactgataaaatttgatgtaataatgcaagtttcttttggaataatttttaccaaactcctttgtcaaatcctctgccaaggcagaaatcaaacctctaccgtactctgcacgttcactgccacccagttcttgctctacaattcgtttacctatattccaataggtaagcagcattgccttactggaagcactataggcagcctcttgtccagaggaaataatgcttttaatttctgtaataactgactggtatggagtcaaatgtttttccatcatgtcacctcgattccccataataattatattttaacttgcttttcctgtcacatcaagactctttctaaaatggtgtagtagtggtgtagtaagtgccattcctctccgtgaaaccattgattttacgggcttttctgggacttttcaagatactgccgtggcagatgaatagtatctttatcatctattttctacctctttcttttgaaatgatatgctggtttttaccctattttatgcggatgtttgaggtttttggatattcctttcttcactatatctttggcaaatcatagcataagtttgcatactttttctttcaatcatgctaaaatgtcatgttaaattagtgttttaacattatcgatttctgcttgatatatcgctcaactgattactactacttttttcaattcctctttcgcatcttcgagtcccagatgtgtgtatgtattaagaggacaccaatatcggagtgcttcatcagataccgaagagtcttgggattcatactagatctcgtcatattaactacaatatgtatgcctgcatacatgttgtgttactttcggcatctctgctttgtatatcctgttgtatttttctcttatatgctgaaagtattttccccagtgtaaagcaaccgtaggtttatcattttacaacaaataaaaaagccttagttgaggcctttttctattgcactattgcatacaagagagataattttttgccaatactgttcacaatcctttcttgctctgctacaggaggaaggggagcagagccctctttaacatatcctgggttagctgattaatggatgttgaatttccatcgtcaaatatacctcggaattggcttgaacgcagatagtgcagaacatatttgtaatagctcgttttataaacagccataaatacaccaaatgatgcaggttctttcaaattaccaataagtgcacattttccaaccattaggcaattcaaatggcaactcatcttcaatacaacgatatttaccatcagagtacatctcataataaaatattatcggaacattcttgttaaaattaaaatcctattcgagctctaatgtcatttaaccactcgcctttatatttaaagaaccttggtcctgcaatcgaatatttctttccagatataagctttgcagcagctgtcaatgacatttccttccccttatattccacttttctatcaccgacaaccttgcacttaatactcggatcatcataatattcgatttcttctcctactgaaatctgacatttaataaaagaaaaattctccgctttttcatggctttctgtgtcaatttcctgtgccaactgttcctccagtgcctctacatcacttggaacaactaatttcagattttctttgcaatcgtggatttctgccattgcttccaaaattgcataggcttcttccggcttcattgcgtagaattcacgaatccttttctgaccattaaagtcatcaatagagcgcaattctggatttagcttatcgataattgtatgaagctttaagtccgatagtcttgagttcacttcgtacgtcgcatatactcggaatgcaaacggaatacactcgctgcgatttaattgcttcaatcgcttgtctatatcatctgcatatcctattttcacataatctgggaaagaaggatttgtgagaatgtatattacaccttttttatcactcatatactttttctccgtttaatttaaaatatttttagctttcccaaaatgcaaattttgccctttggctttgcactttgaaaaatcactttaataagcaatcctaaaataatccaaatacgctttatatttatcctgtgccgtcaagcatgtatttgtcagatttcctttttcgttactccactcttttaatccacgataatagaacatctttagattatcctctatgatgaatggaacaatattatatttcagacattctttaaacataatcagtctgccaacacgaccatttccgtcctggaacggatgaatacgttcaaacttcacgtggaagtccaatatattttcaaaagtcttttcttcttttccattatactccgtcagcagacctttcattttatcggcaacttcttccggaagtgctgtatccattccacctacttcgttcggtatctttttataatcacctacagcaaaccaatcttttctggaatcactagtaccattcttcagaatcaaatgtaactctttgatgaacttctctgtcagcgctgcctttgcattatcaatgatcacatcaatacagcgaaaatgattggctgtttcaatcacatcatccacattcagcacttctttttctacacctatggtattggtttcaaagatatatctggtctgatcatgtgtcaggcggctgccttcgatatgattggagttgtatgttaaatcaatctgtgtcttatggtaaatcccgccagaatacttattttttttctgctcctgcaaaatttccagcaatgttatcggccgttctttcttcttgttggaacgctcaggtttttctgcattttcaggaattttccaagtctttccggtaagaaatgcaccgttcactcgtccctgagcacaataatttctaacactacgctctgatatattccacttttttgctatttcaataactgaacggtatctcatctgctatcctccgtcataaatcaaatcaaaaaaacaacactcatctactgcttagtatatcacattatcggcaaaaatatcaatccttatctctgccacagttctgtttttcagccgataagcaatgtcttattttactccacttcaataaaaaaatagtatttttatcatatcttttatatcccttcataagccttcaaaccttaatacaatcgaacattagcagttcgattgccatgtattacgggctttccggcacttttttcgatttttgttaataaagttgagctcgattttagcaccacaaacaagacagtacatataaagaacgccatccgctgaggctattcattccattttgcatgtcagaagtctcctaactttttcaatttagcattttacagagtcttttttaacattatgtaatcatccgttcggtattcttcgtaaaatccgttttttaggaaaagagaaactgcaggattgtcaattacaatatcatcaaacatgaattcaattccattttgctttgcgcattcacacaggaggttaaggcctagggaaccgtaacctttcccacgatactttgccataacaattatatccgcaatatatatttgcctgctctcgtcaaagtgatatgctatctcaccaacaaacatattattatcatcgagaatatatctataaaaccttttaccatcaggatttcttacccagtaatcataccaactttcccatttatcttttggaaagtgaattgtaccaccccactttttattaaattccatggttttttcatcatttattaattgctcccgaaaccacatgtcttctaatgaaggaacaaccaatttaatcatgtttttatctccttcttaacaatttttacaatatacattttatcaagaaaccatgaatacttcctccattcgataaattgtataacccttcacacccactatgagaactgctacccttttagagtatcctttttcttctattcatctgataaaagttccgtaaaatcacgcattactatctgtgatagtaagagcaagttttgactattgtgaatgtaccgacccttacacaaactggaagctatcgctacaggcagctacagatctcaataatattcttaacaatataatctggcttttcatcatctccagttatttgccaataaccgccaaagccttgttttatccatattgttcgcattcccatttttttagcgggcataatatcattatctattctatctccaatcattattgccttattagcctcacacttagccctttgcaaagcaatttcaaaaattttaggatttggttttgacacaccttcttctgccgaagcaataactaaatcaatatatttcataatcccccatttttctaatctgctttttgttcccaatgattgattagctatgacaccaatacgatactttttatttaatatctcaaggcaataggggacatctttgtataaaatttcatcttcgatataccatttccttttaggaagatgatattttattcctaattcaatatcgccttttttattctgtttataaaattctaatgcttcatcataaataaaagtataatctaactttgtaaattctgctatatcacgaaaaatgtgttcataaaccaaatgctcatcaacaagagttgagccaacatcaaaaaatatccattctataattccaaacataaattttacctctcaaatttgtttattgaatgcttttcgtagttcattactttttgacagcacaaactcaaataccattttttaaattttatcccaaacccacgtgattcttagtaaatctacgcaaattcacgagaaaatggtatagtaagattacttagcgtcattcctttttcagaatagcatactgagatgcatagatacgccttgcttgtttcttgttgaaaaaataaccaaaaaaagcgtgtgccgcttcaaaagtatagcctatcccctgataatcaacatccaacaaggactacatgtatcacaaactgaactttcatcatccggctcttctgttcttgaatatgcatctaactcactaatcactttacctgcgtgtttaagtataattgcggaataatactatgtttcatttatacgtttttcatttcttctttcacttcattcaccatgtacaacttcaaaagagatttagttaatatgttggcttatgaaattttttatcagcgctgcggcttcttccgcattggaaaagagagaagggtgccctccttttgggaaaagatatatggaagattcagaaagcatagaagccatttctctatactcttcttcaatattgtttcggcaactttcatcttctctacttcccatgaataggataggcgtttttaattctttcaacggcttatggaatagcggacgcttttcctccgcacacttcaataaagcttctgtatcaaggtcaactaccttttcccagtctgcgccctgacaccattcgtaaaactgtcttgactgtatatcttcttttgccattttcctttcagataaaagattggtggaaaaatcctcattaagagtacgtccatcaaagctgtccgcaataactacatgaaacaagtcagggcgttccagtgccgcattaacagccgcccacgctccaccgcttgttccgataaggctggcctttccacattgtaaatgttccgtaagcgcgactgtctgcaaagcttcgtcatgccacatatccggtgtaaagctttctactcggtcggactggccgttccctaaaaaatcaatcagaatacatctgaaattttcttcatatagtggcataaggagttcagacattttcgaagaggcggtattgccatgcaggaagataagcggctctccttgtccatattcttcataaaaaacagacttgtcctggtagttaaaatatgccatattcgcacctacctttcttttgctttatctaccccttgtttttgatactctggaagaacaagcaattctgtaatcgtaccaaaaaaatatccgtctgtaagaatacgcaaacatcctacaaacaatttattatcatacgctgtaatattcatcgttctagataatgcggtttgtgtgtgcttcatatcatagtctcctctccatatttgatttgcaaggaaaatgaaggccgaagcaacaagtttagtatcattaactttatattccattgtattcctccgttagttacaagacagcctttttcaaatcagaaataaattgtgcctgttgctttttcagataagattttacaaaaggcttcataaagaattttttgactgttacgtattctgtaaaatcaatctccgttttattatctttggaagtaaaaagaccaatccaatgtcctttcatgttgctgttttccatatcaaattcccaacgcttatatggctctgtaacagtgattgtaaaagtggtcggataaccttctttggtatattctataaactgcctgctacttatgacttctgttttactcaaattactacgccatgtgtaatttttaactgccgtaataatttcccacactttatgaatatcgcaggaaagtgtcgcttttatatttgaagttgtcatcttcagcacctccacagatttcaaattttcattatctcacatttttacacagcagtacggtaatataaacttgccgttctttctatttgattttcaagtatcatattctatgaaaatactttattttttctgctggtttttcatctaatcctactgaagcatatggatctgctatacagctattctaccagaagccgccgtccctttccacacattatcaaaagatagagtaacttctatttcattctattgtaaccgtccaaaaattctgcggatttcctgattttcaggaacctcctataattttagtcgatatatatttagaatgtttcactataatgatggggatcagttacaggtatgctaaaagggagatacacattttgtgctgtctcccttttacaataactgtcatagctacgttctcttaatcatggtaaattaatggtaacataagccttttcattttacgacttcaatatcaaagaattccactttcccgtcttgtgccataaatccgatttcatactccgtcttttcatatacacgatatgtaaaagcggccctttctccgataaatatttctaccatatctttatccataaccacttttacatctatcacttctccttccttaaacaaaaacggcttttcacatacccggatgccatccggtcccggatttttgggcgtccctacatttgtgcaggattccctccaaaacgggtccacatccatcggaagatttacaagagagagtcttttcattccactttctatccgaagttcaagacatcttgacgcatcccggtttgatttcaatagcagtccgcagtaatcacggcagtccgttatccgtaatttacagcggaataaaaatgtttccgctttttctatatttaaaaacccataggaaagtgtacttaccgcatccagctccactgtctttggcccgtacatccggcttgtcccccataccgcttcatacatccacggaatcttttcacacgctgcctccacatattctcgaggcatctttacatccagttctccttctttgtttaccgttacctcgtgcggaatgcaaaacgccccgccccaataccattctcccatatcgctttttcgggcacggtcatgtgcccatgcaaaataaaatcttctaccttcatcattctcacacgacttcgccgcataaaaacgccgtcctccgataccatccattttaggagttctccatgggccaaacggagattttgccacccggtaaattgtattgacgaattccgaaaaccgtgaataggataaataccagttaccgtttattttgtacatttcacaacattccggacagtttgtatgatacggcttataaattgggccgtaatgctcccatgttttcaaatcccgagaacgataaagaacaatacatcctgtttttgtaggcgggccttcttttaatcttcccgaaatcaaaatccagtaacagtcatcatcttcattataaaatacatacggatctctccaatccaacgtttcatataattccggtatgggtttgataaccgggtttcccacatcttttatccagtgaattccgtcattacttaccgcatgacagattgtctgttgggaatcaatgtgataattatatcctgtataaaaaatatgatactttccttctccatagataacggaacccgtccagactccatccgcgtccgggtccgttccctctcccggatacaaagccgtttccaattcctcccagtgaatcaagtcctttgaaaccgtgtggctccacgttgtccgcagccgttccggatataccgtcgttccggtaggcggcgtcaacgaaaaaatatgatatattccatcatgataaaacggaatcgcatctcctgtcgaatctgcaaaagacggctttctaaaaatctccattttctgtttcctccttagtttgtaatttttttctttttcaatttttcggagagtgcttctttccttgaatctaaaatgactgccgccaaaatgataagcccctttacgacaagctgccaaaatgagctgactcccatcaagtttaatccgttgcttatgattccaatcacgattgctccgaataccgtcccgctgattcttcccacaccgcctgacatagaaactcctccaagcacacatgccgcgattgcatccatttcgtagccttcgcctgatgccggctgtccggaatacatacgcgacgccagaacgattccggcaaaagccgcaaggacgccggttatggtaaatacgagaatctctatttttttaataggaacaccggatagccttgcggattccctgtttccgcccaccgcataaatatatgtgccaaattttgtttttcccagaagaatggcaaaaacaacaataagcagaatcatatacgccacaggaagcggaataattccaaataaatatcccgtccccagcattgcaaagctgtcatcggtaattcgcgtggactgacctttgctgtaaatatacgcaatcccttttgcaatattcattgttgccagcgtcacgataaatgcgggaaccttaaatgtcgcaacaattattccgtttaccagtccgacaaccgctcccaaaagaagacctgccgcgattgccgccgccatcggtaaaccgttgtttaccataaacccaaccgtaagagtgccgctcattgctacaatagacccgacagaaaggtcaatcccgccgagaataatgaccattgtcatcccaagagccaaaaacacgttattggaaatctgccttaaaacagaaatcacgttgttcaccgtcataaatttcggtgtaagcaaggtaagtcctatggcaataataaacataacgcttataattccgatattggatttcagcatgaatacaaccggattgttcttttttatcgtgctttgtttattcatttttattccctcctgtggcatagtgcataattgcttcctgattcagctcgttttttgcaagccttcctacaatatttccggaacgtacaatacagacgttatcacacatattcataatttccggaagttcggaggatatcagaatgattgccattcctttttcagcaagttcgttaataattgagtagatttccgcctttgccccgatatccactccccgtgttggctcatctaaaatcaacactttcggagccgtcgcaagccatttggcaaggactaccttctgctggtttccgcccgaaagactgccggcggaaatatcttttgacgcagcttttatattcagttcatccatataattttctatgactcggtttttcttttcttcgcttaaaagcagcccttttttcactttatcaagacttgataacgtaatattaaaaccaacggaattaattaaagtaagtccctgcttttttctgtcctccggaaccatggcaaccccttttgctatggcatcgcggctatttttaaaacgtacctgttctccatccagccagatttctccactgtcatatgtatctgctccgaataccgcctgcatgatttcacttcttttcgcaccgaccagtcccgaaaacccgagaatttctcctgcccgtaccgagaaactcacatctgaaaaaacacctttttttgtcagatgttccactcttaaaagttccttttccagtttattataagttcttgtataataattggtaagacttcgtcccaccatcatacttaccagctcatctgtatttgtttccctggtttttacggttcccacatatgtaccgtcacgcataaccgtaattttatcggtaacttcataaagttcttccatacggtgcgagatataaataatgcttaccttttgctttttcagctttctcatcgtttcaaacagcttttcaacctcttcatcggaaagcgaggaggttggctcatccatcacaagaatcttaatatgaaaagaaatcgccttgatgatttctaccatctgctgctgtgcaatactaagctttcccaccggcatcgttacatccacataaagtccgagtctttccgtcatttcttttgcctgccggttcatcgctttcatatcttttgttccgagttttgttttcagttctcgtcccagaaaaatattttccgatacacttaaatacggcaccagcacgatttcctgatgaatgattccgatacccgtttcctgcgcttcctgcacccctgccattttgacttcttttccgtcaattcttatcatacctgtgtcaggctgataaatccctccaagtatctttataagcgtcgatttgcccgcaccgttctcgccgagcagtgcatggatttctccttcttccagtgaaaagccgataccggaaagcgcctgtgtcgccccaaagcttttactgatattttccatttccaatatcgtcctgcccatctgtaaaccacctcttcttataatgaaaggaaccggtcaaaaagccggttccttttttgtatcttaccgtctttttatccgccggattactgccacttatcttttgtctcctttgcctcatccacggaaaccagatgggaatccagccagatttctttttcgattgtatcccctttcataagagaaactgctgactccacggccgtttccgcaattccaagaggcacttggcatgcaacggctgtaaatgagccgtcaatcaatgcggcttttccatccggggaggcgtcaatagagtacactccgatttcccctgttttatttgccgcctgaattgccgcagcagcacccagcgcagacggatcattgatacagaaaaacgcgtcaatgtccggatttgcctgaataatatcttctgccagcttcatagaatcatcaagcgccgctttcccgtcctgctgtgcctcaatgtcaaatttacttttattgtctccaagcccggaaaagaaaccgtccactctgtctacacagctttcatttgacgggaaatccaagaccgctattcttgctccgtccggataatctcttaccatttgttctcctaccagttcccctgcctgatatgcgtttgtcccgattaccgtttccaccaagtctctgtcgtcttcaattaccgcagtatcgacattgatgaccttaacccctgcatcatttaactcctgaagtccctgccgtatccccgccgaatctaccggaattacaaagaccgcatcaaattcctgatttgccgcatcggataactggcttaactgggtattcaaatcataatccggatcaaaacacgtatactcatatccctcatccttgcataattcttcgaatttctcattcatagaagattgaaacgtattattcaacgtgtttgtcaaaaacgcgaaactataatctccatcttttttagctgcttcctttctgctgtccttgttttccatcgctgattttgatgtacatcctaccagtgtacaagccgtcattaccgtacataaaaaaattgacactaatctctttttcatctgtgaatcctcctttgcaaacccctattttccactgctctcctgcagcttttagtttacgtaaaagatatcacaccaaaaaattagtgtcaattatgtgcatctattttcgttatatttacgctctgtttttttaatttacgtaaattaatttatttgtcaaaaaaatttatcagctttttcggtaccggttcatgcataatttctttccacgcccgtacaaaattgttcttctgcacagtataaggagaaactcccacatacttgtactgcgtattcccaagaagtgcctttgccgtagcaagcgcaaccgccactccctgttcataaggtctttgcgtccccattccctttaccattttttcctgtacaagatattcccctatttcttcgtccaaatcataagtaaaaattgccacgtcttcccttcccagctccttaagcgcacggatagcctgaagggccggcctgtcccaacagatataaagcgcttcaatatcagggtgggttttcatcatatcccgacatatcctgtatgcgtcatctatgttgagaaaattgcttaccgccacaatctcaatgttcggataattttcgcagattacctgtgtagctaccatatctcttaaataggtaccgtaaaacgccgctccgtgtttaataaatcccgcttttacatggtgtctgcctttaaaatattcccccataagagaagccgcaatccggccgttttcccgttcatttacagacacacatgttatgtaatcctttgcctcaaatcctgtcggaacattactcataaagataagcttcgccttttttgagagctttttaaataccggcgccgtaatggtatcgtcacacggaatggcaatgaccgcatccggtctttgcatactgattccttccaactgcgtaacctgaagataagggtcaaaatgtgcatccgttaccgcaactaccgtaatcccgaatttttccagtgtttcccgtattccgttttcatgcagcgtcttccatgccgtgccgccataatgaaaagaaatagcaaccttaaagtccccctctctgattttttccttttcttcctctgtaaatgttatgtcatccggcgaaaacgctttttctccaaacggcccgcgtccgatcatctgcgttgatttacggataaacagcttcgccggaatcctaatccttccaaagctgcatttgcgcttttctatcttatccgttattttcaaaaccgctgcctccgccatcccttctacatcctgcttaattgtcgtaagcggcggggtaagcagctcgcaccactcttcatctccaaatcccaccacggatatatcttccggacaacatagccccatttcctgcatgactctaagcagtttcaatgttagatgattactgcccgacacaatagccgatgggcgtctgtctctgtaaaagcattttatcttttccccatattcttcatttctcataaccgtaagaacatttcttgtgtcaaactccagcccggattccaccattgctttccgatacccttcaagccgttcctttaccgtgcttgattccatacgtcccaaaagaaccgctattttttcatgtccgcttttaatcagatgtttgaccgccttatatactgcctgctcattgtccgaaagaacacagtcatcttctccttctacctttctctccaaaaaaacaagcggaatttctcttgccaaaaccttttcgtaatttttcctgtccgcagtacacggaatcaaaataatccccgctatattcctgtccccgcacagacgcaaaaggatgtttttttccagttccgtatcgtaattactgtaatataccgcagtcaaataccctttttttaacaggctttccgatatatctctcaccagcctgatatataaggtcccacccgcttcaggcactacaacggccacaaccgtttttgtccctgttttccattcttcttttttcttacggtacttttccgtataaccggtttcgtgcattgcgttttctactttttttatcaactctggacttacgtatctcgttccgtttatgacatgagacaccgttgcaatggaaacgcccgcttcttttgcaacttccttaatagtagctcccacacgcacacctccttcgcctttaaaatttacgtaaataattcattgaaagtgtaacatgattttatttttatgtaaatatttccagttaaaactttgttggattttatccaccccggcatgatgttcttcgtttccataaaatttaggggctgtaaaaaaatcgcctaactagaaatcgccagtatcggcaaataccgcttctggcgattctgttcctatccatatcaatatactaccagtgaatttgttctttttatttcgctataactctctttatccgctatacgtaaccactcttttaacttttcattctgctccaacggagtaagggaaaaaatcacttttgtagcgtaaggattgcgtagcgattgagacagcgcactcaacagccctgttgtaatactcccttgcaaaaacgtagatttggcacaaatgaaaaattcgtcgctaaaattatatggatttttcaaatagaaatttgtaacgagatcatgacaggacatcacccctttataaatatatcccgaatccacataatgttccaaatcttcgcaagaataatataccgacacctgatctttatcgtccccatcagttacttcaaaaacacaggcatgaatctgcttatcaattccaaagtattgatacatataaaacaaattactgcgtctgaaaaaattgattgtattcgttcgatatttctcttgtttaacacttttttgataatcaagcagttgatttactgtcacatccagagcttccgcaatatgaaataatgtccgaatatctatggataattttgcgttttcatattttgaaatagcagaaggacttaagtgtaccattcgtgctaactgtgtgactgtaagttttcgctttacacgataaaacttaatttttctacctatatgttccagtaaatcattttgcatcatgtactccatcatattcctcctaactacgttattgctttatattatcatatttttgcttttttgtttccaaattggaaaaacttttcactttgttaattatttatctatattatacttggatttataagagatttcgacatgttttttctgttttggaaaatgtgaattatttttatttccacaatggaaaaaatattgatttgcatttatctataaattaagagaaaatacctataacaaaaaggaattccttcggccaaatatttaattatttattttcgaaagggtgtgcgtatatggaaactcgcagctacaaaaaaaatcgctttgtcattatactagtggcaatagccggaatgagcgtctatctccttccatattttcgttactattactacgacgcctatgtggcatactttggaattaatgacctgcaaatgggaatgctcggaagtatctacggcgctctggccatcataggttattgcttaggtggctgggttgctgacagagtatcattaaaattagctatttccggctctttaattgtaaccggtgcaagtgctattatcttgcttatgaaacctgtcttcccgattcacgttgcaatttatggactttggggcgttacttccatcttaacattctggaatccatgcatgaaagcacttcgtgcattatgcaagccggaagaacaagggcgcggatatgctttgtttgatatggtaagaggtatgcttaatttcctcaccggacttgttgtccttgcagcatataccgccgtcgccaataagattggggaagctaacggaattaccggacttattactttctacggtgcggaagctatcattgtaggtatcattgtttactttgccctcaagaaaacacttccggatttcttggaaaataaaaataagtcacagaaaaataccagttttgcaaaaaatgtattgacaaccttgaagaaaccgactacctggtgtgttgtcattatgatgttcatgacttatggcgtcattattacttataactatgtcgtaccttattgtaccgctgcatttgggatgtctgccgcattagcaagcatcatgggatatgctgccaatggttttcgtttttgtggttgttggattggcggacagattgccgaccgaaaagggttatctaatatgttgttagttgatatcatattgatgattattggagttctcggactgcttttcacaccacgttctatgaattttatgtggatgcttgttatctcaattgctttgttatgcagcttcatgtatagcgctcaggcattgcattacgcagtcttagaggaaggcgattatccggtcgaaatcatgggcgctactacttttatcctctctccaatcggatacggaattgcagaaagtattatgccaatgtataatggatggtgtctggaacatttcaaaggtcttgccggatatgaagctattttcaaaacatttatcgttatgctttgtatagcactgatttcgacccttattttccggaaacttacaaaagaaagacgcttggaacttgccagaataagagataagaacacttctgccaaatcagaaactcaggaataacaatatatattataaaatcatgataggaggttgattttcatgatgaacaaagaacgtttaaagagagtaattactgaaatgaaaaaattaggattaaaacagattcttgtgtctgatgacccgtctatcttctggctcacaggacgcatcgttaatcctatggaacgttgcggagccattctcataaaagatgatggtgatgtacatgctttcatgaataacttattctgttttgctcctttagatggtgtaactatgcactactatgcggatggtgaaaacccatataaactcattgcggatgaattagttccaggccctgtaggttttgataaaaactgggcaagtaaacatacgatttctatattaaaagaacgaaacgatattatcccggaatttggttctgaaccaattgatatctgcaagtctcacaaggatgaatctgaacgagaagcattgcgccatgcagccaagatcaatgatatggcagtagaatttggcattaaccacatcagccctgagttagacgaattaactctttccaacatgatcgaggagttttttgaaaaacacggtgctgttcaagacatccagttgcaatatgtatgttacggaaaaaatgccgctgaacctcatcacggggctgtagctggagaaatgcttcatgaaggtgatgctgttcttttcgatttgtgggcacctatcaataattactggtgcgatatgacaagaactgttttctataagagtgttagtgaagaacatcgtaaagtttatgaaatcgtaaaacaggcacagcaagctgccatagattttgtgaaacccggggtaaaaatgtctgatattgacgcagtggcccgcaaagtaatctcagatgccgggtatggtgaatacttccttacccgtactggccatggagtcggtatgactgtccatgagccaccagaagcaagtccgtcctgtgatcttgttgcagaagtcgggatgtgcttttccatcgaacctggtatttatttgaaagataatgttggtgtacgaattgaagatttagttatcgttacagaagatggatgtgaagttttaactaagtatccaaaagatcttcaggttgttgaataaattccaaaaagtaagtttataaaacagagaatccggttgatgctgatttcttctaattgttagatcatggccgtgtttcacattgctaaatttgggtttgttccccaaaacagaactttgagaacaaaccacctgctatgcacaacatcatcaataataaaagaatccgctttgaaacaggcagattcttttatttagtggtaaaatttttcattccatttatttccctttttctgtcaaaaatgattgaaataaaaaaagtgatacgttatcattgatactatcaaaaatgatatacattattttctgtgcattatcaggattggagttcaaatatgaaaattgcagttattttaacagagttcttaaatgattatgcaaaaaactattatcagtcccttgcattaaattgcgaactatcctattttatatacaaagattttcaagatgcaggagagctttacctcgctctggagccggattatgacggattccttgtcagtgggcctgttccaagagcagccatctgccaacgtgttccttctcttcccaaaccccttatttcttttggaagcagccccctgtgttattatgagtctttttttcagattcaatataatgagaaagacttctatctggaacgaggctattatgacctgatggaatggtattccggagagccggaccggccgttatatgactttctcaaacggggagagtttcacgatctgattatggagatttaccagaacacttccagctattctctcgaacagctttgtgaaatggaagaaaaaattaaagaaagacatatccgtctctggagggaaggacgaatccagtattctgttacacgttttagtaatattatgcctgatctgctccatgccggggtcaaaacctactttgtttatcctaaatatgagattctgaaagaagccattactacattacttcaggaagtttctctgaaagcaatgcttcagaaccagacgacaatcgccgcattgaatcagcagtattcgtcccagttcctattccaaaggcaggccagatcccagtcttcagagtatggaagagactatctggatgcgctctccagacgtaccggcttttctctttcttatgtccgtcgttttgttactgcccttgagacgcttaacaatgaacatgtgacttcacagaatcttgcctctgcgcttgacatcacaccacgcagtgccaaccgtctcttgaaacgtcttctgaattgtggcgtagcagaagaaatcactacggaccaccttccaaaccgtggaaggccggaaaaagcataccgaatcctgaattaaactttttacgaaaacagagcgtatctgacgccaaacacagatacgctctattccgttcctatattgattatgtatgtcacattgtctgatgggcgtttagccatttcacagcacagtacgcaaaggccgcaactgcatttttcattccatcttcattaaagattacttttgcgttatggctgatatacggataaccctcctgcttgtctcccagactgatccgaaaaaatactcccggcacttcttttaacacttccccaaaatcttctgatcccatgataggaggaagtattttcgtctgctctttcccaagcagttctttgacataaccaaacatctcttctcccactgtatcatcgttgactgtcgccggaagttcactggtaaatattacttcagcccgccctccaaacatctccgcggtctgtgtagagatttctgcaagtctttgtttcgccagttctctgacgctctcttcgtaagcccttatacttccgcacatgtaacctgtttccggaatcacatttcctgcttttccagcattgatctgcccgattgtaagagcaagctgtgcgctgcgtggtttttccgcacattctatcacctgtatagcactgtatatctgtgtcaaaatctgaattggattcactccggattcaggactggctccatgagcactctttccgtaaacccgtatctgaaatatatctgctgaagccatcatagcccctttcgtatatcccaccgtgcctgtcggaagatgatcccttgccacaacctgatgaaagcccatacaagcgtcgactttgggattttccagaattcctgactggatcatcaatctggcgcctccgcctccttcttctcccggttgaaacataaatttgatctttccacaaaattcatgtctgtgctcatgcaaaagtctggcagccccaagaagaattgccatatgtgtgtcatggccgcatgcatggctgactccaggtgttctgcttgcatatggaagtccactttcctcctgtatcggaagcgcatccatgtcggctcttaaaagcagagtttttcccggtttcccactatcaaggacagttgtaagacctgactgacagatccgctctgtttcatatcccattttctgaagttcccgctctacataagcggatgttttaggaagatccaacagtaattccggacactgatgcagatctctcctccataagactacctgttgctggattgtttccgcttcttttataaaatccaccatcccctgcctcctttattccggaactccgatttcatccggtatcggacatttataggttcttccttccatctgacggtcaaactcttcctttgcctttcttagaatctccggctgttctatcagtttgacgccataacatgccataactttcgcggcatatatcattcctttttcacctatactgcttcctgcacaggccgtaaactgccagctatgagccggtgctcccatattggtacatgctgtaaagaaataagcggtcggcatcaaatgcatgacatccccaatatccgtggatccataactattaaaacaggttacttttcctggtccttcatacagatgggttcctgctggcaaaccatatttttttcttgtcgcttctgccgccaccggcgtctgtgcatccagctcggccgcaaatgcgatttcctcctgcgtccatggttcttgtgcgatctcattcatagattccgcgaccacttccgcaagaattctgttattcatcgtattgtagcaccctccgagaaattccacttcgactgaagtatctgtcatcattgcagctccctttgctacccgtacaaggcgattgtacacatcttctaccacttcccttgaaaatgcccgtacataataccacacttccgcctgatccggtacaacattaggaacaattccaccgtccgtgatcgtatagtggatcctgacatctgacggaacatgttctcttaaatagttggctcctacatttgtcagttccactgcatccagtgcgcttcttccgttttccggggcatttgccgcatgagacgagaccccatggaatcggaacttcatcgaatttaccgctgtagaaactccggttgttgcttcattgattttatttggatgaaagtttatcgcaacatcaactccttcaaacgctccgcctcttgccatcagcggtttccctgtcagaagttcttcacccggacaggcaaaaaacaaaatcgttcccggaagatttttttgaatcatctcttctttcagcccaatgacagctcctacatgtgccgtacagagcaggttgtgtccacatccgtgaccgtatgtctgttccggaatttcttctttcttggaagaaactttctggctcagtcccggcaatgcgtcaaattctcccataaatccaatcaccggatgcccatttccataggaagccttgattgctgtcggcacacctcctgctcccctctctacccgaaagccttctctttccagatagtcagctactttttcacttgccttgacttctttaaaacctgcttctggattcctccagatatactggctgatttcatcgagctcacccctttttcgctcaatctcttttgacgcaatttctccgtccatattactacctcctttttctgtaaaacttctcattaactaaatatcatcggactgataatacttgcgaatgctacggaggcaatggtaactgttacaaatcctccgatgatcattttaggaagcatatagtccatcgctctttgccggtcctctccctcccattcaaaagaatctactgcctctgttgtaataatctgtgttgcaggataagcaagcatgcaggtaacgccgattgccgctgaagcaaacggggaataccccaacatctttcctatcagtccacaaagtgcagtaattccaatagagcaaagcaaaagaattccaaataccggtacgatcatactcaacaggctggatggtgatacctgggcaaggctgcccggaagcatcaaaagcagaccaaacgtaataatgccagaagatccggattttgcaaaaatatccttttcgagaaacccgattcttgcaaaaatcaagccaaataacaggtaggaaatatttggatttaaaatatagttttccggactggatcccggaatcaatgttgctttcccgacaaaatcagccagacaggcaaccaatgctactttgcagatatagattgtatttgtccgtagattttttggtgtttctttaaaaatacgcatactcggaagacgcagcgctttcgttgtttccacctgctttttaaaataaccttgctgtctttttatgcccagatctttccggatacagaatgtggaaatcggaataccaaaaaatttttgaaccgaaagaaccaaaaccgcaaaagctgccagttccggcctgttagccgcttccgccgcacctgtcactatgatccccgccacagtcgatcctgccaccggaggggctgcaattaacgcatattctcttccgaaaatcagagagcctacagtaaaacaaatcaatgcaatcgctcctatactcacgagcgcgatgactacggtcttccattcccgtatcatatcttccaggttaattaaagtaccgatattagtaatcataaaagcggtaccaaaatttgacatgacagttactaaccctgactgggttgtaatatcatccggtaaaattccactccagaatcctgcaagaaacagtacgcacgcaaacaacaatgaggaaatcgccccttttgtcttttttgacaaaatctctcctattgaatacacgacaaggcatcccgtaatacaagtcaatggattccaaaaactcatcttttcatcctccttctaaaatccgctttttcatcttctcttcctcctgtgcacagtttgagactctacgtctttaaattatcctgattaaaagacgcaaaattttcatttatctcgtttaataatattattaattatgtttataatacattttatctatattaaatgtcaatagccaactgtttttttgtcaattatgtcatttcttagtctctttttcgtcttattaaaagacgtttttgtttattgtgaatgtcctttaatctacttttgagattcttcaaaaaaagtgaaacatggtcaatcccataaggtacttccacatatgttcttctctgaatggaaacagatcattctacacagatattttttccattctcccgttgttattgacaattcttttcttaaatgctaatattttcctggtaaaattgcccataataaaagtgaatgacttctatttcagaaaggattgtttattatgaatacattaaaaagaatatattgcagaactttccagactggtttaaagcttgctttgccctttcttccctatcggaaaccgaaaattgtaggcagtgtcaacgctcttccggacataatcaaaagcaaccattgcgacaaagttctgattattacagatgccggtatccggaaacttggcctgactttccggttagaaaaagctctggatcaggccgaagttccttactgtatctatgacaaaaccgtggccaatcctacaaccacgaatgtatatgaagctatcgctctttataaatccgaatgttgtgactgcatcatcggattcggcggcggctccagcatagactgcgccaaggcggtcggggcctgtattgtaaagcctaaacaaccgctttccaagatgaaaggaattttgaaagtacacaaaaagctccctcttttgatggcggtaccgaccaccgccggcaccggaagcgaaacgacattggcggcagtcatcacagacgcccatactcgccacaaatatgcgattaatgacttcccgctgattccgagatatgcggttctggatccgaaagttacaataagcttgccacctttcataaccgctactaccgggatggatgccttgactcacgcagtagaggcgtatattggcaattccactacttacggcacgcgcaaagacgccattctggctgtaaagctgatttttgaaaatatctacaccgcatatgaggatggacgcaacgtagaagcacgccgtaatatgctgcgagcctctttctatgccggatgtgcatttacaaagtcctacgtgggatacgttcatgccgtagctcattctttgggtggagaatataatgtcccgcacggcctcgccaatgcggtcattctcccaatggtcttaaaagcctacggagaagtcatacatcccaaactggcccgactggcggttgcggccggactgacagatccgaatactccatgtgatgaagccgcaaagtgttttatttctgctatccaggaaatgaaaaaacgctttggtatcggcaatcatattccggaaatccaggagacagacgtcccgaaactggcccattatgcagacaaggaagccaacccgctctatcccgttcctgtgctgatgagtgcagccgaactggaaaccttctactatatgctgatgccaaatccagagaatcccaaaaaagattctgatagatccgatcacggcgaatgatacgaaaggagtgacaaaccatgacggaacacgaaatgaaagaacttgttgtcagacagagaacctactttgaaaccggagcaacactgccggtcactttgcggatcaccgcgctacgcaaactttattccgcaatttccgcaaatgaaaacgcaatccacgatgccttaaaaaaggatcttggaaaaagtggatttgaaagttatatgtgtgaaaccggacttgttctcgaagaaatcagttacatgctaaagcacattcggcagtttgccagagaaaaacgagtccatactcctctgtcccagtttcattccagaagttttcaaaagccatctccttacggcgttgtactcattatgagtccatggaattatccttttctactgacgctctcacctttggctgatgcactggcggcaggaaatacagccattgtaaaaccgagcgcttactctccttatactagtgccattcttcagaaaattctgtcccagtgctttgatccgcaatatgtagccgttgtgacaggagggcgggcagaaaacgcctgtctattgcgggagcattttgactatatatttttcaccggaagccaaagtgtcggaaaagaagtgatgcgaaaggcttccgaacacctgacgcctgttaccttggaactgggcgggaaaagcccgtgtatcgttgaccagacatccaatctgaaactggcggcaaaacgcattgtttttggaaaatatctaaactgcggacagacgtgtgtcgccccggattatgtcttctgtcaccgcgctgtaaaagaccagttagtcaaagaaatcataaaacagattcaaaagcagtatggaaaacatccccttcgtaatccgaattatggaaaaatcatcaataaaaagcattttgatcggattctgggactgattgaagctaaaaaagtagtacacggtggggcttcagatgcaaatgctcttcgcattgagcctactgttctggacaatgtaacatttgatgacgctgtgatgcaggaggaaatctttggccctgttatgcccgtcctgacatttgaccatctggatgacgtgatccacatcatcaatacacatcctcaccctctggcgctttacttctttacttccgataaagcagcagttaaaaaggtcactgcacgatgtggttttggcggcggatgtatcaatgatacgatcattcatcttgccacaacagaaatgggatttgggggatttggagaaagtggaatgggcgcttatcacggaaagatcggatttgatacgttttcgcattataagagcattgtagataaaaagacatggattgacctgccgatgcgctatcagccatatcggagacttcacgataaaatggtgcgcttcttcctgaaataacaagagaaacaggcagacatccaaccacatttcattatagaaacagatacgcacaaaagccgggagatttcgattcatctcccggcttttttcttctcctttgaatagtcaaacttcaaatatctccaggcttcgctccaaaatcccatggataaacgcaattaaaattccataatttgtcatcggaatcccttgtctttgggcgcaggcgtaccgataccgcatttctttttcattcaacatacatccaccgcaatgtacaatcaaacgatacggactcagatcctgcggaaattctgtccccgaagtaaaggaaaactccggggactttcctgtataatttcgaatccactccgggagtttttctgttcctatatcaccgcattgacgatgatgggtacacccttcactgattaggatgttgtcgccgtcttttatcgtttttaagactcttgccccctggactgtatgcttcagatctcctttatatctcgcgaaaaggatggaaaacgaagtcagatacacttccttcggcgtgatcttcgatacctccctgaatacctgactgtccgtaatcacaagggccggcttttcaccaatacgatccagagcgtccccaagtctgtcgtctcttacgacaagcatcctcactcccacgtccagaagctcccggatcacctgctgctgcggtaaaatcaatcttccttttggcgcggctttatcaatcggaatgacaagtacaaccagatccgacggtcgaatgagatcagccacaagccttttttccggctcctgcactctagctgcttccgctataacagctttcagttcttcgatacccgttccggtctcggcactgaccggaacaattcgctcatccgggattccccagacgtggagtctgcccttaccgttccactcatctactttttcgccccagacatcccatttattcactgcaacaacataaggaatccccttttcttgaattttccgcaagactttctcatcttcctcatccggattccgggttccatcgagtaccatcaccgccagatccgccttacgaagtgcctggtaacttttttccacccggagtgacccaaggtctccttcatcatccatacccggtgtatccatcatcattaccggaccaaggggcagaagttccatcgtcttatacaccgggtcggtcgtggtcccttttatctcggagacaacggccaggttctgccctgttacccggttcatcacacttgattttccggcgtttcgctttccaaaaaatccaatatggagccgttcagccacaggggttgcattgatccccatattctgtccctcctttttcactaaaatctaaagtcccggttccctttttcgatttcttccagatgctctctgacgatctgcctgactttctctttcggaatgttctggatttcccgcgcgatcatcgcctcccctttctctcttgtgtcttgggaagcataatccataagatattctttcagcgtcattagggcgtttggcagacaacagttctgaatctggccggacttacaaagggacataaaacggtctcctgtccgcccttcccggtaacatgcagtgcaaaagcttggaatatactccatgtccatcagccagttgaccacctcatccaatgtcctcttgtcgctcacatcaaactgttcggaggattcatcttctgcctcttcctccacatagcctcccacacttgtcctggaaccaccggaaatctgtgaaattccaaggtggagcacccgctctctgcatttcttactttctcttgtggacagaatcataccggtatacggcaccgcaatccggatgcaggccacgatcttcgcaaatgtatcgtcatcgattccattatcaaacatatccggatctatatcgtccgcttttttgattcttggaacactgatcgtatgcggcccgacaccgtatactgcctccagatgttccgcgtgcatcaaaagaccggcaaattcatatcggtaaagctccagaccaaacaggacgccgcatcccacatcgtcaattccgccttccatcgctctatccatagcttccgtatgatagtcataattatgtttcggaccggtcggatggagtttcagatagctctccttatggtaggtctcctggaacagaatataggttccaatcccggcctcttttagctttctgtaattctccaccgtggtagcggcaatattcacatttacccggcggatcgccccgtttttgtgcttcatgtcatagatcgtttttatgctttcgagtacatattcaataggacagttcaccggatcttccccggtctcaatagccagcctcttgtgccccatatcctgaagcgccgtcacctccgcgcgaatttcatcctgcgtcagtttctttctcgcaatgtgcttgtttttaagatgatatggacagtaaagacatccattcacgcaatagtttgagagatacaacggcgcaaacattacgatgcggtttccgtagaaatcttttttaatctgctccgccagagtaaagatctcctgatttttgtcatccagctcacagtccaaaagcactgcggcttcccggtgacttaagcctttccgtttttttgccttttcaaggatctcaccaatgagttccctgttcgttttgttcttccgagcataatccagggtttccataatttcctcgtgattgatgaaatcctctgcatgttttgattttggatcgtacatcttctttcttcctttcttcgggtcagtttttcttccccttcagtgattgataatctccacggtctgtgaccacctcatagccaatcgtactcaccgcttccttaagaagcgccagactttccccagcctccagtcccgtgtttcttttgttgtcgtagaggaggtattttcctctcacgttctgcggagacagatttggcatgacgacatttgcccccgccagaattcccttcatggtgccgttttccgacgccgtgccaagagcagtcgtagccggaagtaaaacacacggaagcatcagccgcactagcgcaagcagatagagtgtcaattccacgcttcctgcctcttctcccgcaaacggagtgtcatggtgtgggataaacggcccgatccctaccatttccggccgaaattcctgcaaaaactgcagatcgtcaatgaaacattctgtcgtctggtaaggcgatccaaccataaagcctgcccctgtctgaaaccccagacgttttaaagcagcaagacagctcatcctgtgttctaatgtctgggcagatggatggagtctcttataatgctcccggtttgctgtctcatggcgcagcaaataccgatccgctcctgcctcacgaaacttccggtaagccttctcagatttttccccaacagagagtgtcagcgcacagtccggaaattcggactttaccgcccggatcagatcctccattctatcctctgtaaaatacggatcttctcctccctgcagcacaaaggttcgaaaaccgtatgcatacccggactcgcagcagctcaaaatctcctccttggaaagccggtagcgggacgcccctgcactccttcggattccgcagtaatagcagtcatttttacagtaattcgtaaactcaatcagaccccgaatgtaaatcttctttccatagacatggtcccgtacagccgatgccttctgaaacaccacatccgctatctctttgtttcgtttggtcagcacatgccgccattcttctcttgtcagcttcgccccttgttccagcgcatcgatcagtcccattgtcctgctatctgtcacagtttcttattcctctcttctttgttcttcgcacgccttttctcctgtttttgtataaagagctttggagctcacaccccagaggcgccccagcttcccggacagagcgctgataatatctcccggcgcatccagtacaatactaataatattaactttctttttctcatagggaagacccatccgtccgataatatagtttccgtactgatggagaagttcattgacggctcccgcctgagacttatcctcaataataattccaatcaccgcgattcttgtctcattttccatgataacctcctgtgtttccttttttgccgtgtttcctttcctctgtttttcatccttacgtatcatccagctccggattggcaagtccgtcagacttgctgaaaaacaaaaaatgggcctaaaaggcccacctttacagacagtttggtatcgactgacagctctcattttcgtcagagcttctttgcttctggtttcacggccttccctttcagaacattcttcaggtcagattgtgctgatttcatcttacaacttttgaaatcagaagtcaatctactataatctaatactcccctttccttctttttctgatatcagtcgaataacttcttctttttcaggtatcgaaactgacgccccttttcgtgataccgcaagcgcggctgcatatgccgcttctttcaacgcttcttgcttcatgcgcttttccataaccgccgcaaggaaatagccggtaaaggtatctccggcggcggtagtatctaccacatttgtcttaaccgcattctgaatgactgtctgcgtctgatcctgatatatcgctcctttttccccaagcgtcagaacaactccggctttcggataccgtttttgcatttcttttaaaatatgatcgctccgcaattctcctgtgatctgctttccttccacttcattaatcagaaaataatcaaccttttccatcttggcataaaggagttccctgtcaaacggagagggattcaggacaatcgtcattcccctttcttttccttcgtcaatcaactccgatataagatttatctcattttgcaaaagcagaaaatcccccttttcaaaatgtttcaggacttcttttatatattcttttgtatttttccggtttgcacccgcaaataggataatgctgttttgcccttcttcactgacctgtatcatggcattaccggttctctcttcaatgcatttaatatagtttgtatgtacgcctgacttttcacagacctcctttaaaaacagtccatcttttcctatcatacctgcatgatagacttctgctttcgccttcgcaagcgcaacggactgattcaatcctttcccacccggaaacacttcaatcccattggaggaaattgtctccccaggtgtcacaatatgctccactttatatgtataatcaatattcattgagccaaaattcagtatcttcattttattttgctccttttcttatccgcaacacttgccctttctataagcaccggttgaaatgtaatacattttcgggaacctctttcgctttccacttcagccgcaagctgcctgactgcttctacccccatatcgtaaaccggctgatgcaccgtggtaagcggaacatccaaaagctccgaaaaaaagatatcatcataaccaatcagagaaatctcttctggaatctttattcctttttgattcatacggttatatgccccgtatgccgacatatcattaaaggcaaaaatggctgtaacatcctgcttcaaaagataatccgctcccgttgccccgctttcacagtcatattttccctcataaaccagttctttccggaaagccacttcatattcatcaagagcttttttatatcctgcaaacctgtcacaggaatcttcaagttcccgcggtcctgttatacatccgatttttttgtgaccgtgatccaacaaatattttgtggccgcatatcctccctgcacatgatcgacaacaacggaactacatgtcgcttcttccaaaaaacggtcaatcataacaaacggcatttttagtttttcgaaaagcttgatactttccattgctttctttttatcgctgtctaatgacatacagaataaaataccatctactcctttatcggcaagcgcctgaatataggacagatcccttgtatgtttatcgtttgtattacacagaaataaattccatcctttttttctacattcatcctccacgccctttgcaagatttgaaaagaacacattgctgacgtcagatataatcagtccgatggtgtccgttcgcttttttaccagccccaccgcaagccggtttggatgataattgagcttctctactgcttctaaaatggtatcttttgtgctctttggtattttgttcgccttattattcaaaacaagcgaaatcgtggtaaccgaaaatccggtataattagcaatatccttaatcgtagttctcaaaatttttcaaccccattgtatactattcccataatctgattcctgtcttttgttatgagtaaagtctctatgtatactatacctcatttcttccatattttggttaaaataatttatttaaaaactcaataaattgcaaatattttttcagctccacgtattcatccggtttatgcgccaaaaaaggctctccagggccaagcaaaatgaccggcagatctttcttcccttccgccagtatagaagcatctgtaaaataattaatgcccgtctgacttgctgacaggtacatgcatctttccacccattctgtttttctgagccataagtcatcaggagcggtttcgattgccattctttcattttctacggtgaattctgttttcaacataccatcggtattccgttcatatgtctgggacaggcagagcgcataccgaagtatttctcctgtcgaaacctgtggaactgtccggatatccagcataaattccgcgtcatccggagtcatattcggcacgattcctcccttaatccctgtaatctgtactgttggctgtcccaaaagcggatggacaaattccgatagtttttcttttagttttcgaaaaatttcaaatccatattccacggcgtttatcccttcttgcggataagcgccgtggctcgttttcccttttgtcttcattttcagccagacacagcccttttgggcacttcctatcttcattcccgtaggctctccgacaagaagcagtaccgcatcgtccatgattccttcttttactgcttcttttgccccaagaccgcctttttcctcatcacaggtgccaagaaaatagatggtcttttccgggatatatcctctctgtttcatgttgccgagtgcatagaccattgccgcaagaccgcttttcatatcgcttgcccctcttgcataaatacatccgtttttcttggctggaacggccggatcggtattccattgtgaaagttttccatacggtaccgtatccaaatgcccgttccatactaccttttctttactttttcctcccagtaccgcaacgacattcgcatgtctttggtcaatctcccgaacggaaacgttgactttgcagtctttcagatactccgctataaagttcgcgatttcccgttcatcatcgactccattcacacttggaatggacaacagttgatttaaaaactcttcttcactgtaatgcttcatcttctgagcctccgtttgcacccgttaccttgtcagccagtccatgatacccttccagatttttgcgtatccttcccattcgcaaaactccggcggcgcccagtgcggcgcgcagtccgacgtaaatacggcactttttcccttgccatattccgaaaatgcgacaagcgggtcatctccgatcatgactgccacctcagcctccggcttcggaatcgttttgttatatcccagcacatctggccatttctccggtattccttttaaggaaacatgatcctttactacgaccggagaaattccatcacaatgctccattctgtcgtcaaccgtgagtacttctaccggaagcacctcctgcactgccgtgtcatgccattttccctttgcgtccactcctgaaaatgtcaggtaaccgcctatcatcaaaagtgctcctccgtccatgacataatcccggattacttttgtcctgtccggcatcttgatactctttgtaaatgtctgtgacggaagcatcagtgtattcgccccgatatctgataaaattacacagctataagttttgagttcttccattgtatatggaaatttctctgccgcaagatgatttggaagaaactctacatcgtatccattttcctccagagcctttttcagccatttttctccggtttcatatacagatgtataaaaactgtcaaatccttttacatgggtcgtatagctcatccatgattctcctgccaacaacacttttttcatatcgttttcctcctgattattctttacttttttctacatttttaacaaatctgctcataagctggttcaatataattgctgcgatcaagatcagtccaagcgccgcaagctgccatacggaatttacattggcaatctgcagaccggaattcagcatcgtgataatgacgacgccaatcagaactcctcccagatggcctgtgcctcctgctacgccgattccgccgagtacggctactgtaatcgcctgcatctccgtaccgcttcccgcatctgcccttgccgtcatcagccaggagttattgatgatcgcactcaccgaggctaatactcccgccaaaacataaaccatcgctcttactttcatctcgcgtattcccgcatattttgccgcttccggattggtccccataaggtaaactctgcggccgaatttcatcttgtaaacgagaataaaaatcagaaccgataccggtattacgacaaacaaaatctggtttggtatgccaaatgtacttttcagtgacagtaaggcaaagctatccggaaatccactgataggaatacctcctgtcagatacaaagccagcgaactgtatatatactgtgtcccaagcgtcgcgatcaacgccggcacttttgccaccgcaactaaaaccccatttaccgcaccaaataccacgccgcccagaagagtaatgaacgccgcaatcggaatatttgctccgttcattaccgcaagcccgaatatgactcctgaaagactcatcgtagaaccgattgaaatatcaattccatcccgtccgcttatcataacaagggcttcgcctaatgacaaaagagtgagtgtcgctccaaactgtgtgacttgcaaaaggttattcatgttaaagaaatacggactgatacaagataaaataatcatctctatcactaacagcaaaagcagaaattttgtcctgcttttcgctatggaaaaggcaagttttttcatactgttacctcctttgctttcttaccagacttctgatttcctgtcacagcgtcaaaaaggacagaaagaacaatcaatgagccgataaagcaattttcaagcagagacgggattcccaggattacgatcccgtttttcaaaaacgcgataaataacactcctgccagcgtgccgataacgctcccccgttttccgtttccctttgctcctgtacctccgattgttaccgccgcaatgcaggcaatcggtaaatctgagccgatcgtcatttccacgcttcccattctcgcgatatagagcatggctgcaaatgccgcaattcctccggatatacaataggaaataagcttgatctttttcacattgattccgcttaaattggcagactgtggattacagcccgttgcgtagatgtacctcccgaatttcctgtacatcagaaaatagtaaaacaacgcatagatggcaatgataaataaaagaagcaccggtattccaaatatctttgcccttgtgataaccccatatccaggatttaaacccgtcagccatttcccgccaagcaaagcgaagattactgctttccatatattcattgtcgcaatcgttacaatcatatccggaatattgaatttggctaccagaaatccgttcaaaaatccgacagcaacaccaattccgatagctgccgcgacaatcagaaaaatattcatctctgcctgaagcatatatccaatcacaatggcgatgacacccatcacagatcctaccgacaaatcaatcccacccaggagcattactatggtcataccgatactgaccatggcaatctccgcattattctgtatgactcttatcaggttatcgaccgtcaaaaaattcggtgccagaataccaaacaggataatttccgcaaacaggagcagaaatgtcacatactctctgcgccccggctttggaacatatttcttcatcatatgtcattccctccgtttatgaattttcctccgccccgcaccagtccattacgatcgaggcaatcattttcgtacatgtgagaagttcttctatttcaataaactcatccgcctgatgcgcaagtctcgggtctcccggcccgatattcagcgtaggtataccgacattacagaaccaccccatatctgtatgacagcagattccttctacgacagaatccggattgacctttcttgcgctgtcccttactgtcttgaaaaacggctggtcatccagtgtttctccacagtctgcgtcaatcagccattccacttttggctgattatctgtaagccatgcgtctgtaagggccacatgcttcacaaactcttctatttccttttttacctttgagccaagtccgttttcatccttctccgacggaagatactgcgcgttgaatgtaagctctgcccggttcgcaaatgtcgtcggatattctcctgcctgaaactgtgcgatatggatctgacatggtatgggcagatacttatgctcttttgccacgctccattctttattcagccttctaaactgttccaaataaagcgacgctttatcgatggcatcaaccgctccgcctgtcctgaaatctccctgcttcagttcaatatgtcccgctcttccttcaatcgtcagttttccccatagaatccctctgcaaagcggcgctattttcagatgtgtcggttccgtaatcagacagccgtccgcacggtatccttccgctaccagggcaagtgttcccattcctcccgcttcttcatccacaacggttccgattcttatatccccctttaatttcattccactttcctgaatcgcttttactgcacaggtcatggcggcaataccgcctttcatatctaccgcacctcttccgtaaagccggttccctatgatttttccgccaaatggatcttgtgtccacttactgccccgctgtaccacgtcaatatgccctgaaagcattatggaacgtcctccgcctgttccttttaattccgcatacagattcggtctgtcctcaaatgtatggtcagcatagtaccctggctttccctcataggaagcaagcttcttcgcatccggatatgtatactctgtcgtcattcccatatcctttagataagcctccagaactctctgtgcatctccttctttcatatatatggtttcttcatcaaaatacggattgacgcttggcgcctgtatcagtttctgcaaaagtcctgtgacttcctccctgttttcctcaatccatttgtaaatcttttcttttgccgtcatagatatcctcctcttcttaccggttttcatttaagttcagcgcattctttaaaatcgcttcttccgttaccgtcttcctgtcaaaccgggccgttatctttcccttgtaaagcgtaataatattgtcgcttaattccattacttccggaaggtcggatgaaatcacgataactgcaacaccgtcctttgccaattccataatataccggtgtatttccgtttttgtcataacatcgattcctcttgtcggctcatccagtatcaaaactttcggcttttgaagaagccatctgcaaaacagcactttctgctgtcctcctccgcttaagctgttgacactgatttcctggttcggcgtcttgatgctgtatttttctatattctcctgtactacctgtttttctttctttttgtggatcataccgctttttccggaaaggctgtccagaaaggcgacgctcatattatccctgaccgaatgaatatcaaaaagcccctgtgcgcctctgtcctccggtacataaaaaatccgtctttctactgcctgattaatattgatcctgcttatatcctctccttcaaaaaatatctgtccactttccgcattggtttctccgaaaatggctcttgctatctctgagcgtcctgctcctaccagaccgtacattccaagtatctgccccggtcttacatcaaaactcacgtctttatataccggtttcaaggaaagatgtttcacctccagaatcggcttttcactctgttttctctccttataaacactcatgttgatttttcgtcccgacattgccgtaataatcgtttcctcagaaatctctttcggtgaaagcgtgccggtaagacaaccatcccgcaaaacaataatattatctgaaatccggaggatctccggtattctatgactgatatacatgatgctgacgcccttattctttaagtccgcaataatctcaaacaacttttccgattcattatggcttagaatcgaagtcggttcgtccagaatcaataccttacattttttatagattccacgtgcaatcagtacaagctgttggttcccgatggaaagttcactcatggtaagatgcagaatctttccgtcaagtccgacgagccgaagcgcttctaccgcctcgtcatacattttcgtccactgaatcgttcctcctctacttaccgtttcatttcccataaaaatgttttccagaaccgacatatcagcaaaaatattcggctcctgatacacaatggaaatccctgtctttaccgcatccagaggcgaatgaagggaaagctcttctccctggaaataaatttttccttcatcgtttttcagtgctccggctacaattttcatcagggttgacttaccagccccgttttctccgattacagacagcacttctcctttttgcagctcaaaactgacattctgaagtgcttttacccctccaaaggatttgcttatcgattcggcttttaataggatttctttttccacgcctttcatcccctttcagaaatcagaaaaggaagtatattcccggttcaaacagccgaatatacttccccttcatcccacttatattgaaaccttagaaatcgtaatcatttacattatccttattaataatcaatggttctcctaaaaggagtgtttttgtctcttcatcccaggtcactggattatcaatgccttcgatttcattcacttcttcaaattcttttccttctacaacctgaactcctgcccacacgtcaagatatccaagcgcttccgcatcccacatgatcgattcttccatcacgcctgaatcgataaatggttttaccgtttccggagaaccgtatccgatcacagctacctcccccgcttttccttcctgttctaccgcctgtgccactcccggaatcgtggaggacgcaaccgcaaccagtcccttcaaatccgaatatcttgtcatgagttcctgcgcctgtttcagagcctgctcgctgcttccgccttgcgtataccggatatccacaatttcaatatccggatatttttcttcctgctgtttttctatccaggaaatccatgaattcagatttgttgctgtggattctcctgatacaatgccgatttttcctttctctcctatctgttctgccagtctgtccatcagcgttcttcctaaatcttcgtcagaggcttgcgcgacataaaattctcttgtactgtctggagcatcagagtcggaagtatacacgtggattcctgcttcctgcgccttctcaatgtacggatttgtagatgaactgtcaagaacggacagggaaatcgcatccacgccctgtttaatcaggctgtccataatttttacctgttccgccgcgttcgcctgtgttgcgccggtatataagtagtctacgcccaaatccgccgccgctctttctccacctttttccattgcagagaaatacgggatcccgactagctgagggataaaggcgattttggtttttccgctgtcttttccggattctgtcttttctccgcctttattttctcccgaatccgttcctcctgtttggcaccctgccagaagcccgaacgtcatcgctgctgtaagcaaaactgccgtaagtgtccctgccttttttctcataaattgttcctcctctttttgtcctgtaagattcattggtaaaacgtttttccaattttgttaatttgattatataccccactaacatttatttcaatcgtcacatttttactaaattctaaaataattttcatcatattctctaattcttttttattttatcgtcattttgcataatatccttttgtttttttgttactttttatatttagtaaatcgttttattaaagttatcttctttatttccaatagacaataaaaaacgcagcagttttaatactattgcattaaaaccactacgtttttcatattgtatcatttttatatttctatctcttttctacggaaaagaacgtttcttcctccagaaaccgcttcacgacccagttaaagatttgtggtcgttttgcggcaagaaaatgatctcctttcagacaaacaaatgtggctccgggaatctgatccgccataaaacgggaatgacggtcccggatcatatcgtgagttccaactattaccagcgtccttgatcggatcttccgaagatctgacggccggatatagggatcttttatcatcagacgcaagagctcctgccgccgctttcctcttccacaaaacctcgtaacaagagacaggaggccgtattccatccagaccggaaagaccgcccaaagcttcatcccggcaggatacagattggctccattcaggatcaaattttcaactttctcaggaaaccgtatcgcaaaaatgattgcaatgttgccgccatcactgaaacctatgatatctgccttatggatccctttttctttcaggaaaacggcaagatcctccgcaaactgccggatcgtaaaaggctttgtccctcttttcgtttttccgtgtcctctggtatccaccgccagtactctgcggctacgggaaaaaaagcggatctgatgcttgaaataccggctgtcctccccgtttccatgcaaaagaatcaacggcttcccgcttcccttctcgatataatgcagatgaatatcatgcatattgaccgctccttttctgaacccctactgaaacaacacagttgcccgtttcatccgctccactacaggaacatcaaacggacatctgacttcgcatcctccacaagcgatacagtcttttgcgccggccgaaagactttcgtaatgcgccttgattgtggatggcacctcttcctgcatcgtagccaaatcatacagcttgttgaccatcgcgacatcgatcccagccggacatggcgcacagtgcccacagtaagtacactgacctgtataagcatgatgcggtgcatgtgccagcacgcttgcatagtccttttctttcgacgtagctgtctcgtaagccaccgcctgcgtcacatgctccgtactgtcatatcctgccaatatgcttgccactccaggtcttgtgagtgcataatggatgcactgaaccggggtcagggcgacaccaaacggggaggtctgcggtgagaacagacgtcctcctgcataacctttcataactgtaatcccaatcccacgctgctcgcagacctggtagagttctgcccgctccggatcaattccgtttagatcttccgcgtaagaatcggcaaaataggtgttcaggtcttcacttgcaggaagcaaatcaaaggccggattgatgctgaaaagaattatctccacaacgccgcttaaagccgcaagctttgccactttcggattgtgtgtgctcattccgatatggtgaatgatcccctgcttctttttctctttcacgtaagcaaggaattctccctccataattttgtggaattccgtctcctcatccacaaagtggatcatgccaagatctatatagtccgttccgaggcgtgtcagcagatccgagaaagcctcctccaccttcgcaagatcccgcgtgcggacatactgaccattctgccaggtagagccgatatgcccctggatgatccagcgctctcttttgcctcgaatggcttttccaatattcgtacgcacgtttggctcggacatccagcagtccaaaatattgatcccataactttcacaacagtcgattatctctttgacttctttctcgttatgacgctctagccactccgcgcccaggccgatctcgctgacctcaagcccggtagtccctaatttcctatatttcatcatcttggccctccatattcctatctttcttcgtttcccatccggtagatccgttcctcaaaactgcctccccctctctatcccaacaaagtccgtaccatacctgcgtcaaatacgacagattttacatgttctacctcgatccggtataaagcgttcgctgcaaggtgctctgccgcctgctccagatcccggattccacttgtattacggtgcagatcgataacagcctccagcccatcgtctgtcagagtacattcttctttttccattccaatgcgcttcaatactttcggaagggcatactgggagaaaatcacctttttctcctccggcgcataatccggaagctcaatcaccgcaaaacgggacatcagcggggcactaatctgagccttgtcgttcgctgtcgcaatcggataaactccaaccgtcgggatcatacattctatgtaattatccgtgaatccaagattatctaataaagtcaagaggacatctgccggattcccattcccctttccagatgctgccttgtcaagctcattgataataaacaccagatttgattctcctgccatggaaaaagcatccatgataatacccggcttcgcattggcatagattctggaacttcctgtaagctgttccgggtcattgatggaactcatgtccagtgttgtccacggcagtttcaaaatccgtgccaccgcataggcaatctgtgattttccggttcccgcaggacccaccaacagaagcccataagccgggagggtatgagtccgattgatctggatgatcgtctcgataattctctgcttgacctgctccatcccgtagagctcttcatcaagaatttttctggcctcctttggatcaatcgcctgaaaataatttcctttccattgaatattcatcattatggagagcgctctctgtgcgtgccgccgctcctccgcggacacttcatgagactttgctacagccaaatttcttctggcccagagacggatattatccggcagtgtccttcctgcgcaagtcataaaatccgtaatactctggatactggtaagtttcatactgtccccggtctcctcttcctcttcatccgggacttccccggacggcgcatcgcttgtcaacagccgctcgatcataaactgtaaaaatccatcctcagcagaaagtttggagcctcccccaaaagcaatctcccggattttataaaccgcatagccgttttctgtgtctgcgccggagaggcggacattgatatggttttcacccatccattttaagagacttataaaccgggcgtcaatctgcaatatatcaacgctttttgttccttcttcttccttccactcaaaggcggtaccacgaaccggattggtaaaactcccactggaatggtgttgtaataatcccttacgattatcaagaagaagtatcggatcttccaaagaagcttcgtgcttattggaataaaatacggtatacgtacactccggatctttttctgcttccggtgtgtgattaaaatcaaaaactggcattgtctgcactcctatctcgtcgtccattttctttagtttaccacaaaacgtacccggatacaatctgctgaaatactgcttgacagatgaggtctgaccagtactataatatagaaatcataaaacaaaggaggtcgcactatgacggaaaaagaactgatgctgtcagaacatttatatatcgcagacgatgaagagcttgccagagatcatcagaacgcaaggcgcctgacccgcctgatcaatactctcacggaagaagatgccaaagaacagagggcgctctaccgccagttattcggccatgtaggtgaacgcttctgggtggaaccgcctttccggacggattacggatgccatacctacatcggggaagatttctacgccaactatgactgtatcttcatcgacgtagcggagattcatatcggaaacaatgtcatgtttggtccacgggtctgcatcttcaccgccggccatcccattgatccggtgatccgtaacagtaagttagaatatggaaaggaagttcacattggggacaatgtctggatcggcggcaacacagtcatcaaccccggtgtcaccatcggaaacaatgtcgtgattggatccggctccgttgtaaccaaaaacatccctgacaatgtagtagccgccggctccccttgccgtgtgatccgggcaatcacggacgcagaccggacctactgggtacaagaggcagcaaaatatcacgaacttcgtaaaaaggaccagccgtaaccggctggcctcctcttccatactttgcccttccttcaagtatttacggtttacatctcccacagggctcatacccccttctgatgatatcttctctgattccgctgtactcacttaggttggaactcctgatatcccccacacttgcacagtccggcttatggaatttctttgtgttggtgttgagcacatacgtctgctccattggactgtccttcccagatccgtcctctttcccggctccttcactctcccggctttttccggtctcatagtcaatttcaattcccggctgcacgttgtacacatacacatagaaggagattccttctccgccgtcctctacagactgcgcttccatcagcacgcccgatgccaccagattgtcgtcctcaaataccggagtcacctcataaagtacatggttgtccgtctcccgaatataatccgccaccatattttcaaatgggagcatcccctcggtgttcatataacgggttccggtgataaggtttctctcattggcattttccgccgtcagttgaaagccgatcagatgacagcgattataaagatagcctccgtccacctcatcatattccttattcatccacccggacggcttcacttcagaaatactctcccgatcttcagtgggcatcagatcctccccgatattagctttcgcagtccggcatcttcctagatgatcgagagggctatatatttcgtaggaatcgttctgaagctcttcatctgaaaaatccggctcgttgttatccacaatcgtataaggctcgccactgtactccggcagtactgccacgatcgactcggcttcttccgcctccttacgaagctcctgggtttcggaatttctcccgaaatcggaatacctgctgtctcctgaaatctgaccgcaggaagtaaagaacagactaaatacaagaacaaacagaggaaacaacgtccgttttcttcgcgtcatgctgtcttcaccgggcaggtcagaactgcaatctggcgtaccatatccggacggatcatcagctcattggactcatatgtcactaccggatcttccttatgcaaaaaagcatccagtgtaccaatcacatcataaccaaaacgttcactccgataatgcatcggaatgatcattttgggactcagctcttccagaagaacccgtatctggtccggctccatcgtatagaatccccctgccggggcgaatactgcatccagatgggaaagagccctcttctgttcttctgtaggcatacatcctatatcaccgagatgggcgatccgcagtccctcggactccagaatcgtaatacaattcgtaccacgcttctttccttgacagtcatcatggaacgactccagatgcgttacttgaaatggagtttctccgtacgcttttacaagcttcactttttctctggcattgtgatccccgtgctcatgacttgtaaacacctcgtttgctgtcaatatttccaatttcaatcctggcacattatcatcttcataaggatcaaagacaatggcatatccatcttttctgatccgaaaacaagaatgaccaaaccattctacttttatttcccgcatgtattcttcctcccttctgtcatttcccggaacaactgatccaactggggaaactgctttttcatacggatcggaattccggaccgatccagaaaacaatgtccggaatgtcctactgctgccagttctccccggcaatacatctcataaccgattgtcattcttactccattatattcttcaatccgcacctgaatctccactacatcctggaacgtcgtcgtctttttaaaatcacagtccacatgggtgattggagaaacaataccgtcggcctccatccggtcaaatccccatccggcctgatccagaaaattcactctcgcttcttccatccaacgaatatagttagaatgatgggtaatccccatccgatccgtctcataataatgtactttatgtatataagtgttcatactgatccctcctgttaaataattccggtcttcttatgtttgtagtaataatagccaataaaaatcagcgccgtcaaaatccatgtcaccggataactgaaaataatcaccgagattgtcggactgattttcagcgctatggaaagccagacaatcctcagtacacagataccgccaagtgtaatgatgaccgggacaatcacatccccgattccccgcagtgcccccgccagaatctcaataaacacgtaaacgatataccaaggagcaatcaaaacgagcatatcgcttccgatctgaataacgttggcatccgacgtaaacatccggaacaaaaaacctcttgtagcaatcaaaaatacgaccattacggtagccgccaccaactccatccccagacacaccttgacgcttttcctgatcctgtctgtcttacccgcgccaaaattctgcccgacaaaagtagtaatggaaatgccaaaagccgaattgatcatccagaaaattgcgtccagctttccataagccgaccatgccgctgtcgtatccgtcccgaaagaatttaaagacgcctggatcgcgatatttgtgatcgcaaacaggatggactcaatacctgtcggaattccaagcttaatctgactgatgagcgcacttttataaaagcggattttggaaatcttgagctgtaacattcctttggacttcatcagcttccatgttacaagcacagcactgaacgcctgggccaataaagtcgcaagcgccaccccaaaaactccctcatggaataccaccacaaaaataagatccagcacaatattcacaatacaacaggcaatcaaaatataaagcggcgtccgggaatccccgatggcacgtagaatactggatccaatgttgtatacaaaagtaaacagaagtccggaaaaatacactctgagatacaaggtagagtctgccacgatttctgacggtgtattcatcatacggagcatggccggagccagcgcaattcctacgatacttaaaaagatgccgcctgccgcggcgatagcgtaggcattgtgaatcccctttcgcacaaactcctcatctttcgctccgtagtactgggcaatgatgacggacgcaccggatgagagtcctgtaaagaatccaaccaccagattaatcatctgggaagacgatccaccgacgctggcaagggctttcgtccccacaaactgccccactacaacggtatcgatcgtattataaagctgttgaaaaaaagttccgatcataatcggaaaaaagaacatcaaaagctgtttccagatcacaccttccgtgatctgatttttcatctgagctgtttccatctgacccctctctctttcctgccgccattttttcttccggaacgggacgcagccgtccttgcacagacaaagcttttccgctctaatggcatccttgcatcagttttcatagattctctttctattctacacgatacggccgaaatgtaaaatattttttcctgacttttcccgcatttcttttgtatttcctcctgtaatttctcttctctttccttcattgtacttttctcccgtctgtgctatagtaaaacaaaaaaaggagaaattcagtatgaaagtgattatttacggctctgacatctgcggtgactgtcttgaaacaaaagcatatttaaaagaacatgcggatgaatccatccagtacaactacttcgatattacaaaatcaaccggaaatttgaagcgctttttaaagcttcgtgacacgatgaatttgtttgccggggttcgcgaaggacatacgatcggaattccgctctttcagtttgaagacggaacttttacgttaaatcagcaggaagcctatcagaaaatgggaatttagcagagtccatcagacggactgacttatgaaatataaacggcaaaaatgagaggaggctctctctaaatatccccctctcatttatatcgtttatatgttttttattctatttttatgctccaacagttacagtactcctcctgttctttcagacggatcagatccggtttaaaccggatatcttcgataatcccctgccgcgacggcaaagaagtccatggctccacacatacatagggagccgttgttttcggtacatgccaaatgcccaaatacggaagctgaggataatacaaggtgactttacggcttccttgatccgtttttaacgtgacacgatccgccatagattgtaatacgattgcatcttcatcgaacaattcgtggcgcagccgtaatctgcggttttcttccaacggatagcgcttattctctccgctcaaaaaacatgcctctgtatgtcctatacgatccggataacactcttctccaaattcgagataataatcttcaaatttcacgccctcttccatcggcagccgaaaaccaggatgcccgcccattccgaaatacatccaggaatccgacaaattataaaccttgtattcgatccgaatctcctgatccacaagagtgtacagtacccgcaaacaaaactgaaacggataaagccgatatgtacattctgtattacacaattccaacatcaactgatctttcgtctgttttataagggagaactcactgtttttggcaaatccatggatccccatctcgtactctttctctccaattttatatttcccatcggtaaatcttcccacataagggaacagcagcggagaccggtctgcccaatatgtctcatcgccattccagagatactcctgaccatcctttatcatcgattgcatttcagcacctttcgacgccactgttactataatcttttcattctgtaactgatacttcataaactaccctcattatttcgcacacggatattctgtacatagaagccggtatggggcttcatcttgcttttgcatagatgaaatacacctgctttttatatctgttattctaccatataagttctgttttgtcataaataggagttctgtttttcaagaattgttatttttttgtctcatattccgtggttttgtatattctataggtactattttaggtaatattgacaaatctaaaatatttcacacaaaagggttcatttttttgacaaaatgtattacattaaaggatagttaaaaacttgtcagaaaggggattattatggcaaaaattacagaaggctacatgccatatttaggctatcagacttattacagaattgttggggaaagaaaagataacgggaaggcacctttgatctgtcttcacggtggaccgggttctacccataactatttcgaggtactggataatgttgcagatgaagatgaccggatgatcgtcatgtatgaccagatcggttgcgggaattcttatctcgacggacatccggagctttggaaccagaaagtatggttggatgagcttgaagctctgagagaccaccttggattagacgtttgtcatatcatcggacagtcctggggtggaatgatgcagatcgcttacgcggttgattatgatccaaaaggcgtaaagagtttcattatttccagtggccatccaagtagttcactctgggaaagggaaggtcttcgccgtattaaaatgatgccgcaggatatgcaggacgcgatcaaccatgcgcttgaaaccggagatttcacaggcgaggcttacgacgccgcagttgctgaatatatggacagatattgtaactactggctcggagaagacgcgccggaatgttgcacaagaccgaaaaaatccggctctgagtcttatgtagaaggatggggaccaaatgagtttgcacctacaggaacactgaaagactttgaatacattgacagacttggagaaatcaagataccttctctgatctgcagcggtatttctgatctttgctctccacttgtagctaagacaatggcagatagaatcccgaattccaaatggattctctgggagcgtgcaagacatacctgttttgtagacagacacgatgactactgtgtagagctcatcaaatggatgaatcagcatgactaaaatagctaatttacatatgagtaaatagacgttacaaaaatcaggagaacatcctcagacatgcggatatcctcctgatttttctataaaatgaggatatcgccacgtgatcagatctttttgcgataccctttagctctagcaggaaaccgaatcctgctcctgttcatattctttcactctgacatcctgaatcacgagaagtgccgctcctgcaagcaacggaacacttccaaaccagacgctgtgaagtccgtactgcagccagataagataaccgaatcccactcccaggtggaaactcaaaagagtccctccaaagaaagctgctttcctgcccttttctttcctgatctcttcctcatccttatagagcagatactctgccgcagatagaactgtctgctttagattgttggtggaaaatatcgttgaactcacataaccgttcgctcctttgaacacgcaccactgaaaagctgtaacaaagaaaatcggataaagcgccttcaccggatccatcttcgcaggtagaaatccgaccacacagatcgccgcaaaatcaaagagcacagcgagatatttcacattccagcgtacattttttgcaagcactgctgaaagggcgatcgccccgataaagatcacaagagcgccaatccggatcagaacttcttccggatctcttcccagaatcccgcatacaagctcgatcatattggccgtctgggcggagccaaacacctgcattctggcaagaatcgcatacgctcctataaatccaccgaatatcgccatggtataatgtacaggtacatcaaatacagtttctctttccacaaaaagcgcctcctgacttcccttattataatcatctttttttcatttgtaaagtctctgcgcatattttaaggacgtgtcctgattcatccgaacacgcccttatcgctgtacttttagtgccagcttcctatcagctatgagtttcaatgtaaaaggcgaacatatctatgaactctgcgtttgttggaatttttgtcatcttacagccggatatcctgctgaagccctccggcccggtctgtctccagcatacttcgatcgccgtccgtatatttcgttccacactctgcggtgtcgttctgacccgcaaagccacctccgggtaaatgttttttgtcacattcagcataaaatcttcatgctccagtacaatttttgtcgcctccgcaagctgctgatatccttgatatttagaagtcagtcccagacctcttaatgtttcgtaaatcagctgcatatgttcctccttccaacctccgttaatatcataacgaatttatatggaaataacaggaaaaactacagatatcgacagattgttacctaaaaaagacaaaaacctacatttcctttttccactgtctcagaagccccgctccaagtggataaggcccggtatgaacccctattgtggcaccaatctgaatatcctcccattccctcacacggaaacccgaagtccccagacgctccctcaggcgcatcttgaattcatcgtattccggaacccagagcccgactcccgtcacaagaaaataatcctccggctcgatcttcaggtcctgtatataagactccatcttatctatgattttctgtaatgattttttgcggccccgacacagctccgctgatccaagttcgccatcatagaattgaatcaaaggcttgattttgaggacacttccagccacagaagccacctttccgattcttcctccatgctccagatatttcaaatcgtctgtagtaaagaaaatatgtccactctgtcggagcgacctcaatgcttctgccgcctcgtccagcgtcttacccgcatttctcatttctaccgcgttttttacaagcattccctgaagagctgtcgcaagacaggaatccacgacttcgatccttgccccctgaaactgctcttccaccacctgttttgcgttgaccgccgcctgcaaagacccactcagctttctggaaagacagatacaaagtaccggtaatcctttcttcacaaaagatagaaaggcgcccacatagtcctgaatcgacggcatggaagtcttagggaaacaatccgggttctctgccatccgctgatagaactccggtatggaaatctcctttccctccctgtaatactcttctccgtcaaatgaaagataaaatgaaacaatctccacctgctctgtctggacatagctttccggcagatcgcaggaactgtcgcttacaatcccaaaattcatggtttctcctcccgttctccattctttcccatctctaatcctcgtcaagttgacttaatacatccgaaagatcgacggaaatgatccggtccacacagttgacaggaatcccacggtaggcataggctcctgattcaaagagcagataaagctttcctccctgaatacagatctgttccattcggttcggaagcgtaaaacttttaatctcttctttctttttcagactgtacttttctgtctctacaacagaccggttataaatcctaagcttggaatccgcatatccgtaagactgagataaaaacagataatttccaaacacttccagtccctgcacttgggaaagaatatctgcccactcctgatcgattgcgacatttccaaaaaactctctgtcctcatccatctcttcatatgcttctttattctgctcgttcagctcaaaatctaccgaataccggttaataatactgtccccggaaagcgaaaaatatcctgcataaagatttcctcccctgaacgccataaaggaatttctggcgagtccttccagaatatgtgtttccaaaaacgggagcggctttttcgttttatcatactgatagttttccagcgcttccattgtgtacaggctgactgctgcctgtccgtctacatagtccgatacccatagcatctgtttcagattatcgtatgcaattcctcctgcatgtgtctgatttggcataataatctctttcacgaagcgtccggttttcttatcaatctcaaaaagtacagaattatgccgcttcgtatggcagtatgcgcttacaaaaatcgagtcctccgttacatccatcccttgcggtgtcatcgatgtgcagatatctgtgattcctgtcttactatctacggtttttgcggctttcagccccggaatgacatatgtgccaaagcttcgctccgccgaaagatgcttcaccatgtcctctgaaaaaaactccttatatccggtaagtatctgccggatctccgagacagtgtgaacagccggtgaagtatttgtacgttccagccatgtaaccggctcattgacgctgcggtatacgacaatataaaaccaaaagcagcccgccaggagaatccatgccagaagcagatgcatccagatgcgcacgccctttcttttctgtgatctcaattttttcccttctttattccagccaccacttcaaaatcgtctggatttcctgatcccagtacttccactgatggtctcctttgccgcttctggtctccacaatatagccaagacttttcatttcctgccacatgtcaatattattctggtagaggaaatcttcctccccacaccatgaaaacagccgagggaccggctttctttcttctttcaatctccttgcaaggtatttcagatcattgaaagatccttcaatcccatccggatcaccaaaaattccttcccagaatccagacggtttttgaacgggattcgctgtcttctcctttaatcttcttgatacgtccaacacgcctgacaaagccgctgccgcgccaaacgtctctgaggctccaagcccgagcttccaagctccataaccccccatagacaccccggctgccagggtatcctcttttcgatctgacatctgcggaaaaaactccctgcagattttaggaagctccactgagaaaaaggtccagtaagggagcccatagcacatatccgtataaaaactaagacctccgtccggcattacgacagcgatcccatactcactgacataacgctcaatggaagtccgccgctgccatatcgtctggtcgtcgctcattccatgaagcagatatgccgtcttatattttccgtttcgggcattccctttcagcccgatctgattctttgtattctgtggaagaatcacgtccatactcgtacatttttcaagaacctccgagaaaaagtccacatgtaacagcgccattttcttcttcctccctccattcatcattttctccccctattataacgcaaaactaagaacagggacacagcaaaatgctgtatccctgaagaatcttccttgcatctagcaggttgctccacctttgagatgtttctgcgccgccagattttcctgctttcttctaagcagttcgtcggacagaagctgcttctttacattctcaaagccgatcctgtcgatcgtatccgcaaaacgttctcctgtgattccctgctcccggaacagaagaatcgctttttccacgatatcgagtacttcttcttcactcgtaaagattttgtcaagcgcatgtccgtgggctacttttttaccccagcgtccaccaatgtagactttgtatccctccatctctgtagccactgctccgaacggacactttccgtcacaacgtccgcaatggttacactgacccgaatccaaatgcagctttccgtcttccatcttcgccacaccgattggacagttgttttctacctggcagatcttacatccacggcatttctccagatccacagacggcactctctgtccaatgataccaaggtcattcaaatccggctttacacagttgttcggacagccgcccaccgcaatcttaaacttatgtggtagtttcacctggccgtaaccatggtaaaatcgctcgtgaatcatttctgacagatggaaggtgtcaatcagaccatactgacaggttgtacccttacaggagacaaccgggcgaaccttggatccggtacctcccgtttccagtccggcgttggcaaggaattccctcagaggctcaatgttctcataaggtactttctggatctcgatcgtcaggcgggaggtcattgtgatttctccacttccgaatttctccgccgcttccgcaatgacacggctttcttccgctgtaatcttgccgtttcttgtaataacacggccgttgaagcagttgctcgttctcttgtcctgcaaaaagcccagggctttcactcttgtaatctcttccggagacacctggaatttcacaccctctaccttgacgtcattaaaatactgtgcgccctccagcacgacagtgtttgtataaccgtatgcctttaatcggttttgaagaaaatagcttcgtttgcctttcagacagacaagcagaatcttctcatcctttgcaagtccctctatggcaccattcacggtagaaagatccacatagaccgcccccgcaatctggggattcggacaaacgtctacgactttgtaacctttcgcctttccccgtgcatattcagccggcgtcatgcttaccatttctccgctgattttattctggagaatataagctgcctgcacgattggatgaatggcggtagagaatggcggtgcatacgccaggtccaaattctccaagtcttccaggcgggcgtccatagcgattgacgtagcagcaatatccgtcattttatctaccgcacctgcacccacaacctgaattcccagaagcttatgtgttcctctatctgcaatcatcttggtggcaaaagagtcagaatcaggataataatgtgccttgtcatctgttacagcgagcacggtctccacatcatatcctgcttctcttgcctgagcttccgtcagcccggttcttcctacgttcattcccggaagtttcacaactccggttcccaacacgcccggataggtcttgtccttgcccgtgaggacctgagccagtgttcttccctcatagttggcagaagatcccatggcagaccactgggacattcctgtgattcggttcttcacaacaacgcagtctcccgctgcgtatacatccggcagactcgtcctcatctgctcatctaccacaatcgtaccacgatccatttttattccggtgtcctttaaaaatgcggtattgggacggatcccgatggagacaacgatcagatcagactggatcgtaccttgatctgtctggattcctgtcgcctcattctcgccgagcaccgcttttaaagcagttcccgtctgaatccggatcccgcttttttgcagatgcttctttacataggccgccatttctggatccagcacgttcggcatgatctgtggcatcatatcgattacagtcacagaaacccctctcacctgaaggttctccgcaatctcaaggccgataaatccgcctcccaccacaaccgcacgtttcacccgatgctcctccacatacgcccgcattgcataagcatcctgcggagtccgcatctggaatactcccggaagcctcattcccggcacatccggaacaatcggagatgcaccgaccgcaagaatcagattgtcgtaggaatatacttcttcctcgccgtttgccagattcctcgcctgtacatattttgcttctgcatccagatggaaagcctctctcccagtcaggacgcgcactccggtgagtccttcaaatttcttcggtgtattgacaatcaactcctcttctgtctcgatcagtcctcctacataatacggaagaccacagcctgcataggaaatatcactactttttgttatcagtatcacctctgcgctgcggtcttctcttttcagttttgccgctgccttagtaccggctgcgactcctccgatcacgagtgttctcattttttcttcctcctgctgataaatgtaatcagttacattgttatatccattatataccggattttcactcgtgacttattatgatttttaatagtataataaatttttcttatgatctatcagatactcagtttcctatccgcaatccaaccgaccagaaggtaaaccagaaccgtcatcacaatatagaaaacatagtcaaacaggccgattcctccccatccgctaatcggagccagatcgaacaactggccgaggataatataaatccggtcaattacaaaattgatgacaaagaaaagaatcaccgcaattaccccaccgaattttgtattgagcaaaacggttcttgtaaggatgacggccagaaatcctacaaccatgacattcatccatgcaatcaaacagagaaggcacatcccaaataccagcccccagtctacctgaatattaacgcctctctcaaagaattctcttaccgcccggagaaattctccaagacttccatcgctggctgctgtaatagtcaaagtagcagctccggctataaagaaagccatgaacacaaatgccatctgcaaaatcccagcaataatcttgcttgcaagaatttcataagtagagtgcggcaccatccaaagcatatagctctgtttcgtctttagatcccggtttaaaattacaatgttctcgataccgacatacaagattccgaacattcccgcaaaggtcataatcagaatactgattgccaccagcgtatcattacggagcactgctccggccacaaacaggactacaaatgccaggagacaagccagaatcaggatcctcgtcatcctttgctttctccattcatatttaatcagatttcccatgttctttcctccctacatgaactctctgtacagatccgctgcactccgtccggaacgcatccgttcctcttccacatcacattcgtaaatcacgctgccatctttcatataaatcgcgtgatcgatgatcgattcaatctcctcaatcagatgcgtggatataatgaccgtgtttttttcactggtggtcgtcaaaattacatcaacgatttcatctctcgctttgagatcgattccgttgagaggttcatccaacatatagagaagcgcttttctcgaaagcgtcgcaatcaccttgagctttgccatcataccagtagacaactcacggattttcatctcctcagataatcccacttttcgcacgagctcttggaattttttttcatcaaatccctcaaagaaatcgctgtaatattttcctaccatcccgatattcataaaatcatagtagaatggctctgtcgacatataggccacctgattctttgcccggtaattccaaggggcgccgtcaaaaataacttctccctgcgtcggcttgacaaacccggtcatcatcttcatccaagtcgtcttaccgcttccgttgggtccaagcagtccgtaaatagatccgccgcagatttttatggagacctctttcaccgctttctttcccatgtacgcttttgtcagtcttctgctctctgctatcatacttcttcctcctcatcaaaatgctcaatccgggatatgatttcttctctgccaaatccgagatccttcatctctttcaaaaagcccttcaacagtgcttctgccatttcctttcgtaattcttcctgcatctgttcgtcctccgtaatgaatgttccaagtccccgcttcgtgtaacagtatccctctgcctccatctccttatagatcctcgccgctgtgttcggattgaccttatataatacggcaagttcccggttggaaggcagcttctctccgggaagcagctgcttgcgtacgattcgctttttaatatctcttacgacctgaacataaatcggtacttccacattgtattccattttcgtcctcctttctgtatcagtgaactagttaaatagtacactagtatattcattttgtcaacatattttccgcatctttcgtttttcttaataactcttcatccataggcgaagatttcgctgcacaagcaacgaaaaagcagtatgagctgcgtatctgagctgtctggctggatcgctacttttcttaatcaacttcataaggtcgaaaaaagctccggttttactttcccataaggaacatgaaaaaaccgaagctctttattctatcttcttctaaaaagaataaagccagtttgcttttttgtaataaatgaaaaaagcaatggaacttaatgtccaggtcagcggataaatccagtagactaccgcaatagacgggatcagcgcagaaactgcagttagaactgccacacgaatcacgcaccagaaaatcatcatcacaaacatcggaatcactgctttccctgccccacgtagaaccgctgccacagaatgtgaatatgccagcaaacagtaaaacagcgcagccgttctcgctctttctgttccaaacaaaatgacttccggcgtccggtcgaaagcggctgtaaagactggtgctgcaataaaaatcacaatcccgatcaactcggccagaatcattgcacacgcaatcccaaaccgtgctccctttttcgtacgttcatagtcttttgcccccagattttgtcccacaaaagtagtaagtgccatcgtaaaacttgtgatcggcaaaaatccaaatccttcgatcttggaataagctccacatcctgccattgccatctctccaaaagaattgatattggactgaactacaacatttgcgatggaaatgatagagttttggattccggatggaaggccaaactgaaccacctgtttgaaaatatcccattcaaaacgaattcttcgaagcctaagccgatattctgccttcgagcgtataagctgaatcatacaaagaatcgcactgaccaactgggaaatgtccgtagctagggccgccccttctacgcccattccaaatactgtgataaaggtgatatccagcaccacattgaccacagaggaaagaatcaggtaatagagcggatgtctgctgtctcccactgcctgcaggatgcctacaaacatattgtacatgacaaagcccagagatcccataaaatagacccggaaatatgcagtggattccggcatgacattttccggagttttcatccacaccagaatctgcggtgcaaaaaatactcctacaatcgtcagaatgatacctgccacgattccaaaagcaactgtcgtatgtaccgctttctcaacgtgttccgaatctctcgccccaaagtatcttgcaatcaccacaccggctcccagcgcgatgccattaaaaaatccaatcatcagttgaatcaggttccccgaagaactgactgccgcaagtgcgttactcccaagaaaattccccacaatcaacgagtccgccgtattatacatctgctgaaacagattccccagaaaaatcggtattgcaaaaaagataatccgtttccagatggggccttctgtcatcagtgtgctggatgtcctctcttccatcctacgattcccctttctctctccatattctttcgtatgcttcatatttcttctgcatctcgtcccgcctgctctttggcagacgtgggatcgcttttcttagttggaaaagtgtttctttcagtgcgtcccactgttttgtctgcctgagggcttctgcctcccataccaaataataggcttcttcttccggccttttttgcatacatgccagcagctttagcgccctgttatagtccgaaagctggcataatgcaatcggcagataaatctggagtgtcgggatcatgctctcccatcttctggctgcttcttgataataaagcagaaaaaaagtcaccacgtcctgactctcccctttctctaccaattctgataagatgcgcgcagcgtaaatccggtcccgcccggagatccagacaaatcctgatgtcacaaacaaggccagcgcccatggctgccacattcctttcagattgacactcagccctgcaatcagtgctgtacaaatcattcccaggcaccagcgaagctcccagatttccctcttgacagccagagtcttatggacacggtcccgtaacccgtctgtttccatgatctgcttttgatccagatgctcaaaaaacaactcccggattttgtcttgaagagccttttcccgaagctgtctgctcttcttactgaaaagactttgccagagaaataccaataccgcactcaatacaattcccgtaatccggtattgcaatctcggatcctgataccggcagacatacaatgtaccacctgcggccaaaagcgccgcagccccctcaaccagtatcatcttccagactttaacttttgtttctccctgctctcttccggacctttgaaatgccgccagataaaacactgcggcacatcctcccgcaaagcaggtcaaaagcccctccctccttgcctgaaagcggaaaaccaaaacaccgccttcatataacaatatccccgcaagaaacacagagaaaatgcaaagtaatctccaaatcttcttcgtcatatgatcctcctagcctgcttcctgcaaagtttccgtaatttccttctcaaaggtgaagtgctctccgtcctcggaagaaaagagtgccttgatcatttgtccgttatccgcataatcgccatcttctccctggccgatcaccatgtaccacataccatcctctatgtaaaaccgctccacttggtcaaatgggttgaatcctagtttctccacagcctctgttgcctgcggcaatggaatctcccggaacgttgttcctcgatctgtcgtgcggtaaaagacactctgctcctgtcctgcggcatagcatccggtctgatcatccgcccagaaggcggcacttacattgctcattacctggtcttctgtagaaatcagtgtccatgtcttgaggtcgtcactcatccacgtcccgtaatagtcgtttccaagtgcgcgatccacggcaaaaacagcagcataacctccttcattcctggaaagaaaggtgtttgccttgtatcctctgttggtgatccggctctcattccaggatgtaccctgatcctcactatagatcagaaccgttccctcactgtcaaatcccagaaaagcggtaaaatccggggatatcagataactaccatcttccaagcgttcatcgtatcctccatttggcttgccgcagactttctcatatccgtctggtacttctacaaaagattctcccgcgtcataagtaacaaacagccctccatcccgaatgtaatacgtctcttctcggtcagtctgcatcgcaaaatgctctgtctgaggtttacgcacctccttctgaaactccggcgactgaatctgatattccacaggccgcatcttctctgtgatagtagatatgccatccctctcttcaagcctgactaccatctgcccctggtatataaatctgtctgcggtaccagaaagtgttttgtccgctcccttgctgcctagaaaaacaagctccagattttggatcatcctgctgttgacacaggcaggtacaatcgtgtaattcagctgaacatagccattttcatccagcacttccacttcgtccaaacgtgctttcctgatccggtaatcataaggaacattcattccgccaagagcgtccgcatagtccgtaaaccattcccggcatacttccgcttctgactttcctacactggcaatctctgccccgacggccgcaggactttcaaactggcgccaccggaactctgtccaggctgcacaaagtaacactgctcccacaagccccaaaagactcacagccaatcgcttcatacttcactccttctcgttccaaatcactgtctttgtctattatatcaccttttgtcgcacaggaaaagagaggacacgcttattccagcttcccctccctctttgcaaattctatgatatctttcaggccggccacttctctagccgtttcttttagtttatctgcacagtacaccttcctgcagcgctgaatccatttttttgcttcttctacatgcttttcttccattttccgaaatggcggtacactcacgacaacagatgaaagtgccgatgcagcagtgtagtccaaatcattttcccagagaatccccgccgcaaacgggatcctctgtctttgcagatatcgaaagtacatggtgcccgttcccatgcctgcgatcacaaatatttccggctctccctttattgcggaaagctccagatttcctgtcagctcatcgtataatcctgttgtcatctgataaagtctttggatatacccctccgtaaaaatctcctccggcgtaccaaatctgtcaatcctgtcctcatatacacaggcaatcttatccgaaattctggccgccagatcaagttcatgcaaagacatcaggacacaaagtcctgtttctttggccatcttctgcagaatcgaaagaaactccaacttataccgaatatccaaataggaagtcggttcatccagaatcagaagatctggctcctgacaaagagcccgcgctaacattaccctctgcttctgtccgtcactgatcttctgaaaatcctgctctttccactttgctattccgaccacttccatactcttgtcgacaacagaccaatctttctccgatagtactccaaatttaccggtgtacggataccgcccagtagacacaacgtcccggcaggtcatccgttctgtacgcacccggtctgtcagcacaaccgagagctttctggccagctcgtttctctgcatttcatctgtcttctttccatcaagataaacaatgccgcaaagtggtttcatctgccgaatcacgctttttaaaatcgtcgtcttaccagctccatttggcccgatcagcgtcagaatttctccttttttcatctggatgcagatatcccggatcaggggaactccctggtatccaaccgtcagtcccgctgttctgaaatagatctcttctttcatcagacttacctcattctttccttcttttgatggatcataatatagatcactacgggcgctccccagattgcggtcacagtgctgatggataattctacgggagcaaaaatcgttctggcaagcagatcacaaaacagacagaatactccaccgcccaaaaaacaagccggaatcatcagaatcgggcgcgccgtccggaaaaagcttttcaccagatgtggtaccgcaatcccgacaaaagagaccggtcccgcaaacgcggtcacactggcagacaaaatgctggatagtaaaacaagcatcatccggaaaaccgggacattcagtcccatatttttcgcgtaggcctctcccatctcataagcactgatctgttttgacaaaaggaatactccaagggacgtagtaagcactacaactgccattaccgctacattctcccagctaataccggaaaaactgccctgtgaccagttatgcagattgacaatattcgcatcatccgcaaacgtgacgataaaatccgtgacagccgaacagatatatccgatcataactccacttacaatcagcatggacatctggtcgatcaccctcgccgtaagaaggacaaatcccatgcaaagcatggagcctgcaaaggccgccataatcagcatccatgaactgagctgtacggcatacccaagggatacaaccatcgtcagcgcaacgatcagtttcgctccggatgaaattcctaaggtaaacgggctggcgatgggattgtgaaagaaagtctgaagcagatacccggacagagccaaagcccctccaagaatcactgtcccgaatgctctaggcatccggatttccatgagaatttcccggtatgtcgcgtctcccttttctccttcgatgatcagtttcgggatttctgtgaacggaattcccacgctgccaatacaaatattcaacaggaagaaaaacagcgtaagtacaattaaaacagcgaacgctgccacacatcgttttcgcttcatcttagtatcactccagtcgatagatataggtgagagtatcttcctccccgtgcaggatcctgtacagatccgatatgatcgatcctagtttcatagtagactgatacaaatttttgcttgtacagtagacgtttccttcttccactgccttaaaatgctccagaagaccgctcttttccgtcaactcatctactgtggagatttctccgtccactgtactattatagataatataatccgcatcttttgccgccgcataaaagctttccatatccatactcatagttgaagatacgctgtcatcctcctcatcctgtttcagaatatagctccctcctgccatctcaatcatctttggcagatagtctgaagctttgcgtacattgacttctccgttagacgtaatatagaaaaacgcaaccgtctttccggtagctttgtcctgactgatctgctcaaacgcttccttctccctgtcaaacgccgctgtagcttcctcttcttttccgctcagcagcccgtaaagcttcacccattccgttcttcccagtggttttttttcataactggaatagtccacgaaaaccgggattcctgatgactccaactgttctttcacctctggcgtatgatagatcattgtattttctatcgccagtccgcatgattcatccagaatctgctcataatccggagcagaatattttcccgcgtacagaatggagcctctctccatcgccgtccttgcttcctccacataccaggactctgttttcaaagaactaaaccgtatcctatctaaggcgttgattgatacaaacatatccataaccgccgaggccgcaagatagatatggtcaatcggctgatacaacaggacaatcccctcgtccagttcttggggtgtcttttttccttccggtatgaccagatacctgtctccattggatattgtaatgagtacatatccgtccttataataatctaccgcaaactgctctgcgtaggaaagctccatgctatgatcaaattccagttcctgactgatttccttatcccggtctttcagtgtttcctcttcctcagaaggcttctgacaggccgctatggaaaccgtcaggaaggtacacagaaacactgcaaggcacttttttcttatactaattgttttcatccgttttgtttccttttcttacagtaaacggccgctcctaccgccacgatcagaacgcctgcgccaactgccgtcataacccagataccgcttcttttttcagaccggatttctattgtcttttcctgaaacgtcaaggtatactcgatctcatgggacgtactcatcgcagtcgtatctgctgtcactgtcactggttcgtcaaatgccaaaaccggaatttcaaaagttgaatactcctctccttcgattggaagaaacttctctcctccgacaatcatataatcataatgtgagctgctccattgaattctggcgtatgcacgcccatccttaacagtcagaaccgccggagacgtaatagatgctctcccgcttccacctttcatagtaatctcgatcgtatattctccgtcttttttgtctgtgcttcctgccgcctctgctgcctttccagagagtacagatgaacacaccaggaaatatcctgctgccagcaaaaggacgcctgtttttatccattttcttttcattctgatttccttccctgatatagaattcccccgctgtaaaagcgggggcttctatcatcgtgattttattcggtcttttccggattagcaatactgaccttatgatcgtaccattttcccttcgttccaatcaaggcaagatcaaattctttctcaagctcaggtaccgggacatcatatccataaacctcttccgaaagcccgtcatcgtatgtaaccgtatctacggtcggttccagcaattctgccccctctttctgtgcgtcttctgccagtcccggatagagattcacaatattctttgatgtcagggaaatatggatcgtcatttctccatccttgacggtaagagttcctttccctttgcatgcttcactgacatgaaacatgctgctgtctgttttaaaatctgccgtatagataccatcttccagtacattctctttcttctgagtctgctccgtctctttctttgtctctgacttatcatctgtgccaccgcatcctactgccattacaacaatgcagaccatcacgcacagaactgctgccatccttttcagtcgttttctcatcctgtcctcctgttatgctccgattgctgctgcggtatgtgcaatgtaaagctgctggatcgcgttaattgctccaaggccgctgatctgcgtatcaactgtttcaaattttccggaattttcaaacatgcttttccaggaatcttcctcgtttcctgccatatcgttattggcatgatctccggccactaccatcagcggacgaagaacaacatttttatagccttcctgctctaaactgctcatcactgcctcgcaggatgtctcttctggttttccttctacggtaccgaccaatacattatcatatccaagcactgtcatctgcgtctgcatctggctataggatacctttgcggtatgggatgttccgtgtcccagaaatacaaacgctgttccggcttcttttgccgcatccagactgtcaaatccggcctcgctcacagccacagaagtcacggcctccgctaccgctttcttatcgctgttgattgtcgtggcatcagagcctacctcaccgagaagcggctctgcaatcctgacggacgtaaactgatcccgatattcttccaccgcacttacgagctcatcgtattctgccccgtgcatcagatgggtcggctgtacaaccagctccttcacaccgttatccactgcacgctgcaatgcctgctgcatattgtcgattttctctccgtcacgtgcctgaacatggttgataatgatctgtgcggtaaacgctcttcttaccgaccattcaggataagcttcctgaagagcatcttcgattcccttgatatcctccacacggctgtcgttgaaagatgtaccgaagctgactacgagcagctccttttccccgatgccatctgcatttctcggatcatctttggatgcgtccccggtatctctgccaaaatagtctggatctgcattctcaccagataccagctctttctgagcgtctgtcagtgcatcccaggcttcccttgcctcttcacactggacgtccgtctcatctgttctctcctgaacatagattgtatcgatcagatccgccacatggtctgccgcctcctgatccgacgtcccctccgtcttctcttcctttgtctccgtcttggataccggctcatctgatcctaaaccggagcatcccgaaatcagcgaacatgccagaactgcggagcaaaacattgctgcaacttttctcttcttcatttttcgtatcctccttttttttcttccagattctgtgaatgaataaaaagtgatacgaaaaagaaaacccaacgcatatggatgcagttggattgtcgaaatataattcggtacaatcaaacctcgtgatctggaattctacattcccgtaccacagctctggcaggtctcctggctcacagtcattgcatattgcagccttcccgatttcacagtgacatttttgcaatacgctcctgcatacagtgacgagatcgcacaggcctctcacctgtttccctattatccgcagcctatcctgcggcaccatctgttttattctgttttcagtcaaatctgttctgatttagtatagcatgaaacgaatagggcatcaaccccgttttcctacccgtgttatcttactctgtatgcctgaatttcaccaatagctgaatgatatttataactctttgtgaatcatcaggaaaccaccgccattgcaaccgttcccgctgtgagcagcagtaatccggctagggctttgcctgttaatttttctccaaacacaaaataggaaaagactaccgtaaccagaacactcagcttatcaatgggagcaaccacacttgcaggtccctcctgcaatgctcggtaataacagagccatgagactcctgtagcaatcccagaaagacagataaataccagttctttcctgtcaatcttctttatgtctttttcttttcctgtaataaaaaccattccccatgccataatcagcaccacagcggtacgaattgctgttcccaggttagactctactccggaaatccctattttcccaagaatagcggtcaaactggcaaaaaaagcggagcctgccgcataaagcatccagccgctcttcccatctgctttctggtccttaacgtcttttttctcgatcatcaggaaaattcctgccgcaatcagaaatacagccaccattttccgcagactgatcccttccccaagaaaaagcaaagccagaaggatggtcaatacagtacttaatttatcaatagggacaactttgttaatatcccctgtttgtaatgcccgaaaatagcacaaccatgaagccccggttgcggctccggataaaaccaaaaacagtaaggttacgccactgatcgcagcaatctgcgatcccgatcccacaatccagacaatcaaccaggaaaatagcaggattaccatcgtccgcagggacgtggccaccgtagaatctgtctttcgaatcccgcattttgcaagaatcgacgtaattcccgcaaaaaaagcagaacctgccgcatataatatccacatctttcattccttctttctactgaatctcgatctgatattcctttgttgtctatttagctatacatttcccgcgaatatttcaggggcaggtgtgactcatatgagtgagtcacacctgcccctgtttaagtctgcctgctttccggcagcacctcgtttttctgatccgtaaacttacattcctgcctgagcagccacctctgccgcaaaatcgtcaactttcttttcgattccttcacctgtctcgaaacgtacaaatttcttaacagtaacttctgcgttgttctcttttgcaactttttctacatattttccaacagtcagatcgctgtcctgaacatatacctgatctaacaggcaatactctttcagctctttgttcagacgtccaacgatcatcttttcgataatattgtccggtttattcggattttctttctttgcctgtgcaagaagaatttctttttcgtgatccatgaattcctgagatacttcatcacgggatacatatttcggggacatcgctgccacctgcattgctacgttctttaaacatgttctgatctcatcgtttactacatttgtatcagcttctacaagaacaccaattcttccgccgccatgaatgtatgcaaccacacaaccttcggatgtgattttctcaaatctccggatattcagtttctcaccgatcacagagatcttctctgtcagagcatcctgaactgtcttggatggatccgcattccatgcctcagccataaatgcatccatatcagcagcacttgttcccagagcctgctctacaacagcgtcaacaaatccctggaactctgcgttcttagcaacaaagtctgtctcagaatttacctctacgattgcagcaactttgtcttcctttacagatgccttaaccagaccttctgccgcaattcttccggctttcttctcagcttttgcctgaccgttctttcttaaaaattcaacggctgcatccatatcaccgtttgtttcactaagagcttttttacagtccatcattcctgcgcctgtcatttctcttaattcttttaccatgcttgctgtaactgccattttgctttcctcctgaatcattgtaagaaatggattattcttctaccgtttctactgcttcttctactgcctctgcgtcttcgccttcaaatacttcctcgccggtagcgccctgatttgcttctaccacagcatctgccatcttagaaacaatcagtttaacagctctgatcgcgtcgtcatttcccgggattacataatcaagctcttccggatcacagtttgtatcagcaataccgatcagcgggattcccagtgtgtgagcttcctgaacacagattctttctttcttcggatctactacaaaaatagcatccggcagcctcttcatatctttgataccgccaaggttcttttccagtttttcccattctttctttaatgcgatgacttctttcttcggaagaacgtcaaatgttccatcctctgccattgcttcgatctcttttaagcggttgattctgctctgaatcgtcttgaagtttgtcagcataccgccaagccatctctcgtttacatagaacattccacaacgttccgcctcggtcttgatagcatcctgagcctgtttctttgttccgacgaacaggatggtgccgccttctgccgcaatgtcagatactgcctggtaagcttcatctacttttccaacagacttctgtaaatcgatgatatagattccgtttctttctgtgtagatgtactctgccatcttaggattccatcttcttgtctgatgtccaaagtgaacacctgcttccaaaagttgtttcattgaaataacgctcatgttttttcctccatttgtttgtggttttacttccgcatgtttctgcctcccggaaccggatgaaacctggcaccgccggaagtaaccgcatgcgtgtttttttgcaacattcgtagtataacatagaaaaaacggctatgcaagccgttttttcatcaaactcaatatttgagtaacgattcagccacaagaacagatttaactatgaagctacagctctgatctgtatggatgaattgttgaatattgtaactttcttttaccagtatcttctgtaccacggtgtaccgcaggaataaacacttgaaatcttaacaacgtctcccggctgaggagcatgaatcatctgtccgcctccgatatagataccaacatgtccaggatagcacactacatctcccggctgcggactggatactgccctgccgcctgctcctaacgcggaagaagtcctatccacgctgattcccgcaacgctgtgacaatattttacaagtccggaacaatcaagccctacacctggtgtgtttcctgcccatacatacggtgtaccaagacagcttcttgccgcgctgacgatcctgctcgccgcactggtatttcctgtacttgtggaagtattcgagccggaacctgtgctcggcttagatgcgcttggcttggatgtacttggcttctcagcagtatcgttcttattcgtattcgatgttccaccgcctgacggccgattggtagtattaccggaagccgtattcccactcgtctgattgccggacgtacttccctgaccggatgtcgtattagaattcgacgcgctctccttggatgccgcttcttcctcagcctttctctgagcctcttcggcagcctttcttcttgcctcttcttccgccgcagcctgtgcgatcgctgcctgaagctcctggtcaaggtttgcaacctctgcctgcttctgcgtcagcgtctcactcagcgcttccttctgactttcaaaggaagcctgcatcttctcaagcttctccagatctttttccagcgactctttcaaactggcaatctgctcttttgtctctacatattcttctaatttttctctgtcatagttatgtaccgtctcgatatagtctgcctgattcagaaaatcagcgatactattcgatgtaaacaggtcttccaaagccttggtgtccccctgctcgtacatatatttaatccggactttcatcgattcatactgctgttcctgcttcttttccgcctcggcaagatcttcctttgctttctgaatctcttcacctttggtgatcagcttttcttctgtctcggaaattttggaaaccatcgtctgtaactgtgcctgtacagactgtacttctttttctttctgttctttctcagcttgaatttcatcagtattcggtgccgcataaaccggagtcgcaagcattgaagcagccatcaacgctaccaccagtctcttcccaaatttgttcattctattctctcctgtctaaaactgcatgtccgaactctttcggtccttcttttttatactacatggtctagtatatcttattcttttttattttgcaatgatttttaatagttttgtaacatttttttagaattctctaaattccggataaggacaaagaaaacggaagccgtaaacgcacagattacagtaaccattcccatccgaagcggggtatggaaaatccatccatatccgttcccctccgtcaaaaggacggaacctagattagctgaggcgtgaagaatgatcggcgctttgatgctttcaaaactttcgtatacataggacagaagaagtccgaatacaagggcatacagaaactgtacgatgtttccgtggataatcgcaaagatcacagccgaaaagaggatcgctttctttgccggcatcagatcccgcagtctcctgaaaatcacaccccggtacagacattcttccagaaccggtacaatcactcccaatccgatgatctctatgatcaccggagcagcataaagtcccgcggacgtcgtttggtaggaaacgctgatactgccaagattactcagaataagaatattgttcagtgcaatccctgctgtcaccccaagcagtaccgtatacacataactgaccgcaggagctttccatggcgtcttatgttgctccggttcaacaaacatcttccggtatctttcgtctttccgcatcatataaatatagaacggaagtgcaagcaacgctgacgctgatgtgatctctgtggaatgacccaggataaaagtcattgtctcttccataaatgtctgaagtgcgctctggctttcatacgcctgcatcagctcctgaccgtgggcggtcaaatatgccgcgacaaccaccatatccaccagaaagctgatgccccagtagatcaaaatcggaacaataattcccacaatcggatttcccggtcttctgtttgactgattattgaacattgattatctcctcaaaatatgctttgattgtcttttcttctccgattaaggatccctggatcatggcaggcttaccgcctccccgtccatggaatctcacattgagcttcttccccagttcccggatgtcccgatcccggctcccgatcacatactggtactgctctccccgtttcagaaataccccgcaaatcggaaccccccgttccagtaccttgttcatcagatcccgcatcccgttctgattcaggttcgtctcaaacagacactgatacctggagtcctctggaatctgctggactttcagttcattcatccttttctgaagctcgatgatctgacactttctgtcttcattctcctccatcagccttcttactgcttccggaagctcatcctcctttgcagaaagcatggctgaaatctctttcatatcccgttcccgtttctcatgatctaaaagtgcccggtcgccgctcaccatcgtcacacggacgccgcccttataattcatcatggcaatcaccttgatctgtccgatctctcctgtgctccccacatgggtcgcacagcaggcacagcggtcatacccaggaacccagacgatccgcacctgaccatcgatctcgatcttactgcggtattccatcttctgtaattcttcctcaggcgggtacagaatgtgaacaggaagatcctcgtaaaccgcccgattggcctcctgctcgatctcttccatctcttctctcgtgatcggaccgttaaaatccatggtacagatatcgtctcccagatgaaatccgacgttctgatagccgaaacggccatgaaccagaccagagagaatatgctccgccgtatgttgctgcatcctggagaaacggaccttccagtcaatctctccctcgactgtatctccctcctgaagtggtccctcagtatagtgtaggacctctccatctctttccttggtatctctcacacggacgccgccaatcgttccaatatcaccatactggccgcctccctccgggaagaaagccgtgcggtccagtatgacctcatacccttcctgcccgggcacctccgtacaagaacgcactgtcccggtaaaagtctttgtatagacgtcctgattatataatcgttctgtcatgtttcattacatcctttccggcgcttcaaaaccaagcaggccaatagaagtcataagaatgtcttttacaagatccagaagagcaagataaccttgctgtttctccttatcttcttctccaagaatccggttctcgtgatagaaacggttgaagctgttggccaaatcaaagatatatccgcagatcttgtgtggagccagctcttcgtaagcctgttccattaccgcggtaaattttgctgcttccaacattagtccccgctcagattctgaatgtggctcactgattctgcattctgccatgtctccgccattttctttatatttattgagaatggatttgatccgcacaatcgtgtaaaggatatatggaccagtatttccctcaaaggaagcgaatttgtccaggtcaaaaacataatccttggctgcctgattggaaaggtctccatattttagtgccgcaagacctaccatttgcgccgtcttctcggcttcctccggtgcaacggttcggttttccgcgatctttttatacatttcctcattaattccatgaatcagatcagacagacgcatcaccccaccggctcttgtcttaaacggctttccgtcctttccattcatcgttccaaatccgataaatgtcaacttcgtatcttccggaacaattcccgttttctttgcacatcggaatacttgtacgaaatgcagctcctgacgtttatctgtcatataaatgacctcatctggatgataaagcttttctctctctaccagagttgcaagatctgttgtatcataaagtgccgctccatctgacttcagaatcatgcaaggaggaatctcttttgtatccgtctcctctttgacgtccacgaccagagcgccctggtccagatgagcaaatcccttttctttcatcatctttaccatatccggaatatatggctgtgcatccgcttcccctttccagagatcaaacgttacattcagattctcatagttacgtttcagatcggcgatagatacacgcataatatgcttccaaagggcacgatagccttttctgccattttgtaattcaaaagtcgccgcaagcgcttcttccttataatcctcatgctcctttgcatatgcgctcgcatatggatagatctcctccagatcattaattgtaaacggagcttcttctggatactctccttcatactgttcatcaaagtaaacaagttctggattacgcttgcgaagctctgtgataacaagacccatctgatagccccaatcccccagatgcacatccccaatcacctcgtgtcctttaaaacgaagaatccgttttaaacattcaccgatgattgccgagcgtaaatggcctacatgaagcggctttgctacattggccccaccataatctaaaataatacatcttttctgagaatcatgctctacaccgagttgatttgcctctctcatttcctgagtataagatcccaggaactctttttttactttcatattgataaatcccggatttactgcctgcacatcttcaagggcttcacttccttctaaatgaactgccacatcgcctgcaatgatcatcggagccttatgataggtcttcgccgccgccatcgctccattgcactgatattcgcataaatccggacgattggaaacagtcacctttgcaaagtttgggtcatatcctgctttttcaaatgctgctttcatttcttcttccagaaaatctaccagttttttcatctcatttgtccttctttcatctaaataaaattacatatatttcttattctagcatacgagagaaaggccaacaactatatttttatggtcttgcgctttttttatttttcatatataataatagaaattattactgtttcgagaggattgattatgacaaaagaaaaaagaaccactccgctgcttggctcccatgtaggaatgagcggaaaagatatgcttcttggctctgccagggaggcagtctcctaccatgctgagacttttatgttttataccggagcaccgcaaaacacgcgccggaaggaaatcagtgaactccggattccggaagcatgggactatatgaatacccatcacatttcacagatcgtcgtccacgcaccttatattattaatctgggaaattcggtaaagacagagacctttgatctggccgtccggtttcttgccttggaaattgagcggaccgctgcctgtaaaagcagcaccctcattcttcatccgggcgcccatgtgggagctggcacagatgccgggatttcccagatcatcaaagggttaaatgaagttctgactcaagataccccttgccatatcgctctggagacgatggccgggaaaggttcggaacttggcagctcttttgaggagctggcgaggatttatgatggcgtcacctgcaatgacaagctccgggtctgctttgatacttgtcatacccatgacagcggttaccctgtacgagacgactttgacggtgtcatagaggagtttgaccggattcttggaaaagaccagatcgctgtctttcacatcaacgacagcaaaaatccgcagggagccaaaaaggaccgacatgccaatattgggcagggtgagatcggcttcgacgctctggcatacatcgtccatcatccggattttatggaaatcccgaaaattctggaaactccttatctgccatctgtggatgaccctaaaaagacacttccgccgtatcggcatgagatcgaaatgctgcggaaatatagagaaaaaacagttctgtaaaacaaaaacctgccggaatttccgacaggttttctacacacctaggcggattcgaaccgccgcacccgcctccggagggcggtgctctatcccctgagctataggtgtatcctacgtcttgtgaacgcgtaaattataataccatatctttctgaaattgtaaagagaaaaaaatcgacaattttccggatatttttcagtttatcattgaaattttatctctgattcagtatgatagatgataaataaaatcttgtaaggaaggatttatcatgcagcttcttaaagaacgtattttaaaagacggggttgtcaagccgggaaatgtattgaaagttgacagtttcctcaatcaccaaatggacattgacttaataaatgaaatcggaaaggaattccgcagacggtttccttctgaaaagattacgaagatattgacgattgaagcttccggaatcgggattgcctgcattgcggcacagtattttcatgttccggttgtatttgcgaagaaagcacagagcatcaacattgacggagaggtctatcactctaaagtagagtctttcacacacaaacgtacatacgatgtgattctctccaaaaagtttctggggccggaagatcacgttctcattatcgatgatttccttgccaatggctgtgcccttatgggactgatctccatcgtcaaagatgcgggcgctacgatcgagggcgccgggattgtcattgagaaagggttccagcaaggcggcgatcagatccgcaagcttggcgtacatctggagtctctggcaatcatctcttccatgaccgatacgtcactgacatttaaagaatagacgaaagggccggactccggccctttttgcttcgatatcttttctgttactgtctatttactcctgcttccatcagcaccctgacttgtccaccgcacacaaggccttcctctgccgcgtcccggttgttcaaatcagaagattctatccggatcctttctccgtgggtcatcatttccatcgctgcctgcacgatgtctgcttccaatttgcctccgccgatcgttccaaaacactgtccggattctcccacgatgaaatgggtgccttcctttcttggcgccgagccctgtctctccaaaattgtggcaagaacaaatctctctccctctttcagacacgtaagcgcctgacgaaacacctcgtacccggcacggaggggatttcctaccctgcttctctcggaaagaatctgtgccagcacagcaactgctatttcctccggcgtctgggcgccaatagaaagtccgatcggtgcgtgaagccggttgatccattctgcgctcactcctgccaaacgaagttcctcccgcatcatggcagacctcgtcttgcttcccatcatgccgacatagtaggattctttctttgcgatctccagcagacatttctcatcgtaagcatggcctcttgtcataaccacataggccgtattcgcctcctcagtcagatcccgaatcgccttgtcaaaggggcggcagatgatctcctgagcgccggtctctttggcacggtcggcaaagtccttccgatcctccagaagaatcgtatggatccccgcaaaaacagaaagctttgcaagggcggatccgacatagcctgctccgcagatcaccatccgatcttcctttcccactgtctccaaaaacaacatctctcccgatactcttcttcgcaacgcggtccccctcgcccatgcctcttttgcaagatcacagatttcttctttcattctctgatcatcaggacctacaatcgaatccttgccttcttcctgctcccaaatccaagttcggatctgttgtttcctatcaagcagacggacaatcagcccgccctccttttcatataatgccttcatccggcataaaaacgctctgtctgtcatcgcttcgctcccatacaaatgcaggaacaccctgctgccctattaacagaaattcttttcggtatcgtgcaaaaaagcaccgtccctctcccatcgcaaacccacttacaagtgcgacctttttcgcctgacagttctggaaaatcccatctcttttgcaaaacaataccacaagatcaaacatatccaccagatcttcctgattttttcccagactgcccgcacaaatctgtgggcggtgcgccacttctgaaaaaggatgccctactgctttttggttcaggatacccactaccgtctccgcaaagtccggaacgaccggttcgtttgctcctggtctcttgatccatttccctttggccccatccgcctccacaaaaagccggatcccggcttcagccaaccgggcgagtatctgctccgggacggggccaatcttcccatttccgaaatctgttccgatggtaagaggaagtgtcccgcagcctctgatctttttccggatctcgtcgacagaatctcctgctttccattccacaaatcctttcttaggcttccacatcttcgtcgtcgttacagccgccgccagaagtcctttctggaggctttccccgacgcaggtgtagactgccgtcgtcttgcctccggctccgacaaacgctgtacagcaattctcctccagacctaattctccaagcatcttctctcccattcttccagagccctgcacacactgcctccgatggcaagcgccttatcggagatcaggaaacagcgtgcgttgctgtctgtcctcggctcaatatccataatctttaatcctgtcgtgaccggataaccttcccgaatggctccccgcagcaatcccgtcagggtcgcacatactgtctgtccgtcgatcaccgccaaaggttcccccttttttaccagatcgcccacctgtctcagatatcgaatctcgccggaacacggcgcataaatcaccctttctgaggcataaccgtcaataacacccggtactcccgtattcggcagcgcagttccgctttgataaacccttgcaaggctctctccccgcatcgtttcaataaccagatccgtatccactccagccgtaaatccaggtcccagcccgatcgtaagcggagccatatcaatacgagtacccagatttttcttggccagaatcccgtctaccagcgccaatggctgaagccaggaaagacaggtacagcccggatctacgagcacaggtatctccccacgttcccaggcacgaatcgtcttttctcggtttgtcacctttcttgcagtgattccttctacctcacagcggccttcatagacggcctcgcaaaacgccacctgacggcgaatacaggctggatgctctgtctccagcacaagaacacgataaccccgtttcgccagaagataggacgtccctgtggcaagatctcctccgccccgcacaatcacagtccgtttctcgtccatatcccagacttcctctttttccgccttctgtcgatagacgtcctccggatgccggcacagcaccttttttccaccaacgtctccggaaagactgcgaagctctggaaaatactgttctccaaaaacgcatggattcttcggaccgccccggtcaatacatccaatgcctttcccacttttcagatagccttccagcatgttctccagtgtaccctgttttaaaaaaggttgatcacacacacagaaacagactgcatcccctggcatccagtggggactgttctgaaccacgtccagtgccaactgtatcgagtgggaaatccccctctttggatccccattgaccacacagatctccggtccatccgtgcacagcttggcaagttccctggaaacgaccagcacggtgcatcctttccaaggtgcggaaattctctgtattttctcgagcaggatggtaaggaggctttttcctcccacctgctctgacagtttgtcctcactaccatagcgcagactttgccctgcggcaagaatcgcaacatgtatcctcatcatttcgtatgtttcattcccatatagactttttcggctgtaatcggaagctcgcggatatgaactccggttgcgtttgctaccgcagccgcaagagccggtgacggtgtattgatgacaatctctccgatggacttcgcgccaaacggcccggtcggttcatagctgctttcaaattccaccctgatttctccggtatcctgtctggtcggaatcttgtactgcataaacgaattactgaaattccttccctgttcattgtagacaatatcctcatagagcgccattccgattccttggacgattcccccctcggtctggactctcgccagacttggattgacgactgttccacagtccacgacagccacgtaatcgatcggagtcacttttccggtctccacatcgacttctacttccgccatgccaaccataaacggtggcggagacgtcggagaataatgcgcctccgaagccatcagcgcctcctcattcgcacacatcacccggtttccgatatcttttaacgagatctcctttccatccttcgggcaccagacgcgcttaccatcaaactctgcatcctctgtccggcatccgagatactccgcccctttcaaaaggatcttttctttcaatttttcacaggtctttacaacggccatgcctgtcacataagtcgtactggaagcataggatccggtgtcatatggagaggtatctgtgtctacaccggatacgataatatcctccatctcacagtccatgcagtctgctgccatctgcgccaaaatcgtatcacatccggttcccatgtccgaggctccgatcatcagactgtagaatccatcatcattcaccttcatcgccacagacgctgtatccacaccggaaattccggacccctgcattgccatagcaacgccgatgccatgcactttgccgtttcccatatcttttgccggatatttttcatcccatccgatcatttccttcgcacgctgcatacagcgatccagggcacaactctttgccgtctctccataatatgcaggcatgatctggccttcttttaccatgttgagttcccgtaaacgtaccggatccatcttcatctgctccgccagctcattaacagcggactctaccgcaaaaatcccctgggtcgctccgtagccacggtaagctccggctgacatcacgttcgtataaaccacatcgtactgaaaacggaaagcgtctgtctttccataaagcggaatggacttgtgtctggaaagtcctacggttgtcgggccatgttctccgaaagctcctgtattagaaagtgtgtaaacgtcaatcgcccgaatccgaccggtctcatctgcccctgcccgcacatggacttccatctcatggcgcggagaggaagcaatctgtgactcctctcttgtgtagataatcttagatggcctcccggtcttccaggtcacaaacgccgggtagacctcagacactatcgtttgtttcgccccgaatcctcctccaatccgtggctttataacacgaatctttgattttggaattccaagggcatgggaaagaatccgtctggcatgaaatgtcacctgggtggacgaaacaacattgagccgtccatagacatccatataacaataggtacggaaggtctccatcattgtctgctgattggccttcgtatggtaagtctgatctaccacataccggcactcagaaagtacctgatcaacatcgccgttctcttcttttccgctggcacataagttcctcttattatccgcccccacattgcagagacttcgccagctttcctccggatgaacaaggatcgcattgtcttttgcctttctgaaatccagaagaggcttcaatacttcgtattccacttttatcattttcatcgcccgatccactgcttccgccgtctctcccgcaacaatcgccacagcatccccaatgaatcgaactctctgatccagaatcagtctgtcataaggacttggctccggatacgtctgtcctgccatcgtgaatcgctccttcggacagtcctcatatgtgtagatcgctacgatccccggtactttccttgctctggagctgtcgatattacgaatcagggcgtgggcgtgaggacttctcagtactttgacgatgaggcagtccttcggcgccagatcatcagtatagaccggtttccccgtcaccagcgccttggcatcaatctttggtatcgcctgatttacctttttcatacgtctatcctcttctttctctcagatacttttccactgcccggagttgtccggcatatcccgtacaccgacagagatttcctgccaggtactcccggatctcttcccggtttggtgtcttgccgtccgtacagagctcccgctccatggccaacacattcataataaatccaggagaacagtacccacactgctctgctccttctgccgccagataagccccaaatcttgccgcttcctcctgaacaccttcaagtgtcgtgatcttgcagcctgccgctcttgccgccaggatggagcaggacagcctcggtgtcccgtccacccagacggtgcaaagcccgcagtttgtcgtctcacatccacatttcacactgtagcatccgaggcttctcagtatatcgaagagcacggctcccggttctatttctgtacaaactggtttcccatttaattcaaactgtacttccatctacacattcccctcttccaatgctttttttgcacggcacagcaaaacctcagccaggtgcttccggtactctctgctgccccgcatattgcttccatagtcgaaggcgtctgctatatgctccatttcatctagtgtcgtctctgtcaccgttgcccgcatcggtctcgctccgatggacaccagtacaatcccctcataacaggacgccgcacaggtcagcaccgggaagtccgtctgacttctgcgctccgacagatagacagcacgtcttccgtcctttgccacaatgatctcttccagaatatctctgtcccggtccatcgtgataaattcagagagcggaatgatcccctttttgtacaacttcaccttggtatcaaacacaagaaacgcggtcagaatatcggaaaatccgtatcttccgaaaatactgcctcctaccgtggctccatttcggaactgcactcccacaatatgtctcgtacattctttccaaaccgatccgaatgactttgcaagtcccggatgggtttccaactggcgcaaggtacacatactgccgatgtgaaagtctgtgtccgtctctgtgatctctccagataaaagcccggagaggtcgatggccgtaaggatattccccttgcccatacgaagccacatcattccccctataatccggttggcccgtttctgattcagctcgtaagccgcctccagcgtatcaggctttatatagtttttcactgttatcaaaatgtttctcctcccgtcctctgaaagtatccatagttctttttattttaacataatcgtactttaatatctacatacaaagctcctttttcctgcaattatagtaatatacagtgtcggagaggaactcttcttttgtcacttctgtcctgttaatactaaatactgcttccttcagctcggaaagccctggatttttgctctccggtaccaaaagtacttcatggatactgcttgggagaatataaaaattttccttccactcctctccgatcatctcaagcagtcctggatacagcaagactgccgccccataatttctctgcatgtttgtcagcacatacataagcccatgaagcagttcactccttccgtatcccggaaacatttccaaaaccaaattctgaacatccgcaatctccgccggaagcaaacgcggtgtgttccacctggcagcctgaatgatctcttcctttgcaatcccccagagtgataaatgtccgtttgtaatcagcattgagatagcgctgtacttttgcacggaaaactgcacataaaatacgacgctcaaatccagatatggcagatgcggcacctgggtcaaaatcttccgatttctctctgtgttgataatccgatagacgatctttttccttatcctctcaaagtctctcagatgctctgcctccatcaccggatcaggaatctgacgggcgtgttcataccagttgattaaactgtctattacccgttccatttccatcccgtgaagataacgttcgtagtactcttccatatagataaccggggaaattccctccttctctgtctgaaatacaaagccctgccgctcttctccattgttcttgagcgtcctgtaatcctccacacggacttgaccatgtaattcctctttcaatctttctttgacatttgctaaaaatacctgatactccatcgaaactcctttcgagcccgcgaagttttccatgatctgataaagttctgataaaaatgagtttatgaattgtattttgattggtattaggtacattatacgtgccaaacaggcgcaatgcaactgttttcgacaaaaatacaggacacaggttaaatttctgtgtcctgtaagtcttctgattctaatagatcgtcaccttatactctggataagtactctcctgtacgtgtgtcaatctttaatacatcaccttcgtttacaaacaaaggtaccataacggtagctcccgtctcaacggtggccggctttgtagcgcctgttgctgtatcaccctttactcctggctcagtctctgttacaacgagctctgcgaataacggtggctctaccgcaaatacttctccctggtaggagcagaccttcacttcttcgttttctttgacgaacttcagcgcatccccaattgtctcctcgttaagtgcaatctgatcatatgtctcgccgtccatgaaatggtacagatctccatcggaatacagatactgcatggactttctttcaatatgtgctttcgggaatttctcggttggtcggaatgtcttttcaaccacaccgccgctgattacattttttaattttgttctgacgaacgctgctccttttcctggttttacatgctggaattccagaatctggtaaacgtttccgtcaatctcgacggttaagccgtttctaaattcgcctgctgaaatcatctttaaatcctccttaaacgaatacaaccgtattcttttctaaattcttatctttcattatgtcttattttatatgattcctgcccttttttcaactgtaagttacgaaaaatactgtcatcttacaaatttctctgtactaaatagagctaaccatgaagtttccccaggatctcatacagctcttccactgaaatctgacctggcgcagacgccttatcataagctccaaatgtcacacaggaaccaaaaagctctccgcccagccgacttaatgctcccttcttccccatggaaatcgaaatcaccggagtatccggatgccggattttcatctcccaagtcacttttaaaagctccaccacgtcttcgtcacactttggcattaccgcaagctttataagatccgcccctgcctgctgcatggagcataatctctgtatcatctcttttccgtccggcgtcttttcaaaatcatgacttgagagtaccgtctgcactccctttacttttgccgaccgaagtagtccgtcacgaacacttttccctttgagatactcaatatcgaccaaatcaatatagccggaggcgatcaatgcctcattcatctcacaatagagttttggggaaacagccatgtttccaccctcctccttcgtgcgaatagtaaaaagcagaggcatctctcccaaaatgtccctcaacgctcttgctgtctttaaggttttctccacacattctgcctccgggtctgtatcaatacgccactccacgagatcggcatgggttttctttaccttgtctgctgccgcaagcacccctgttgcatcccccatcagaggaacacagattttcggtattccttctccgatcacaagatttctgactgtgactgttttcatgtctgtccgatttcctttcttaccagagtctctcaaaatcgagccttgtaaacacacaactcccatactgaccgtcccggatacagatcagatccaaaccgtttttctggaaagaactgaccacgcgatccatctgatccagatcctcctcaaacaagatgacgacactgtaccgcccgctgtttttgcggatcttttcaatcactttctcaatggcacattccttctgaaagaaaataagcaccagttccggctctctatctattttatccagacactgtatctttgtgatctgatatctattcttcaactgtttttctataaactccagtagttccattttcttctgccctcttttgttacattttcttctcattataccccccccccgaaaattttcgtcaagcaattttcagggacggttttccaatgagcttccccggggcaggtttttatacaagtttctttttcttcttcagataaaaatgaagtacgattttctccagatatcgcttcagaacaatctggatttcctctttcggatgaatcggccggacgaggatattgcggatacctgaccgctttgccccccatacatccgtaaataactgatcacccacgaacagtgtcgtattccggtccgtccccataagctgcatggctctgcggtaattctttccggccggtttgtgtgcattaaaaatgtaaggtacaccgatttcttcattgaacatctttacacgcggctcctgattgttggaaagaagacagcacgaatatcccagctctttcagatcgcgaaagagctgctttgccctctcgtctgctggggccccgtggggaacgagggtattgtcaatatcgaaaatgattcctctgtatccctcctcgtacaatctgtcaaaaggaatcgcataggttgacgatatatactcatccgggaaaaagcgctctagcatgttctctcctccgccctctgaatcaacgcatttacctcttctttctccggcatagaacgaattgcgccttttctcgtcgttatgagtgccgcagctgcattggcaaaggtcagcatctcttttaaattttcatccgtgagatgtttgatcccatgctccgaaagataatttaacacactcccgcagaacgtatctcctgctcccgtcgtctcaatcgtctcgcaggaaaagcctttgcagtccactcttctgccttgatagtatgcacggcttccctctgatcccagagttaaaagcacaagcggaatcggatactggcttgtcagccattgaattccctcatcatagtcctcctttccagagaggaactggatctcattgtcggaaatctttaagatatcacagtatccgagtccgtaatggatctgctcctttgcactctccagactgttccagagcggcggacgtaagttcggatcaaaagagatcagcacccctgcttcctttgccgcttgtaatgcctttttcgttgccttgcgaactccctcatgtgtcatagaaagcgtgccgaaatgaaagattttcgctttttttaggaaatctagttccacttcctcttccgtcagcatcatgtcagctcctggattacggtagaaagaaaaatcgcggtctccattttccagtgtatggacaaaagccaatgtcgtatgaatgtccggatccagatacagatactctgtacagatccctgcattttccagtgtttgcttcaaaagcagtccaaactggtcctgtcccacttttccgataaatgccgtcttctttccaagtttattgagcatggcaagaacgttgcatggtgccccgccgggacacgcctcaaacacctgattcccctgactgctcgttccgttcattgtaaagtcaatcagtaattcacctaatgcaatcacgtcaaattctgttttcatatctatcgatctccttcgtccacttgtggttcctttttcgcctttctttatcataaccagtttaccgcattttttcaagcattttcccgacatcagcctgaaactgtgtccatttttccgggtagtccacgaaatatttcgggcagatttttcctgtgacgtcatagtgtcgaatcagatcgttttccgtcaggttgaatttcaggcacaaccatgctgaaagcctcaccatggaatcatatgttttctgattgaaagatcccgattcatctgggtggcagcactcaatagatacagtatctccattccggttattggaagcataggctacttcccaagtcgggatacactgaacaatctccccgtccagcccgacaataaaatggctgctcgctttcgtcaagtgggtgtctttgagtccctcaaagtaatcccggttctgcttagctgtggcgcctggattagccgtatagtgaagtacaatattacggatccgggatgtccccgtctccggacgggagtaagaattcggtgtcagaagatccactgtcatatccggccgaaaggcgtccaccgcctccccctccatctcccggtatccatcaaaaaacgggcctgcccccgcaagcttcattccacccagtacaaataccaggatcatcagaactaagagacctgctttcatcagtcctcctcttccatttcctcttcttctctgtcttgtctttcgcacgtcattattccctttctcgtcttgtagcttccttctattataatcaaaaaaacgggtctgttttttaaaaaaacttcccaaatttcttaaacttttcttatccagagtgaggaacaaagcggacaagtcctcctccaactctctaaattgttccatccttgaaagactttcctatgatataaaatgcccctgctcttccccatccaaggaaaagcaggagctcgtacatacattcttattcgtctacactgtagttcggcgcttcctttgtaatatgaatatcgtgcggatgactctctttcagagacgcggcagaaatcttgacaaatctaccgttttctttgagctcttcgatcgtatgagttccacagtaacccataccagagcgaaggccgcccatcaactgaaatactgtgtcttccacagtacctttatatgcaacacgtccttccacgccttccggaacaagcttcttcgcgtccgactggaagtaacgatccttgctgccgttttccatagcggcaatggatcccataccacgatataccttgtactttcttccctggaataactcgaacgttcccggactctcatcgcatccggcgaagatacttcccatcatacatacatttgctccggcagcaatcgccttggtcatatctcccgaatacttgatgcctccgtcggcgataattgggatactatattcctttgccatctcgtagcagtccatcacagcgcttacctgtggcacaccgattccggcaacgacacgggtcgtacaaatggatcctggtccgattccaaccttgaccgcatctgctccagcctcaatcagtgcctttgtcgcctctgctgtagcgacatttcccgcaatcacctgaagatccggatactgctccttaatcatacgtacgcaacgcagtacattcgcagaatgtccatgtgcggagtcaagaacaacaacgtccacttttgcgcggacaagtgcctccactctttccaggcagtttgctgtgataccgactgccgcgccgcagagcagacgtccctgctcgtcctttgctgaaagcggatacttgatctgcttttcaatatccttgatggtaatcagtcccttgagattaaaatccttatctacaatcgggagtttctcctttctggccttggcaagaatgttctttgcctcctccaaagtgatcccttcctgagctgtgatcaatccttctgaagtcatggattctttgatcttctttgagaaatccgtttcgaatttcagatcccggttggtgatgatccccaccagcttaccattctcggtaatcggcacaccggaaattcggaatttagccatcagattgttcgcgtcttccagtgtgtgttccggcgacagataaaatggatctgtaatgacgccgttctctgagcgtttcaccttgtccacctcttctgcctgagcctcaatcgacatattcttatggatgattccgataccaccctggcgtgccatcgcaatcgccatccgatgttcggtaactgtatccatcccagcactcatcatcggaatatttaagcgaatcttttttgtcaaatgtgtagacaggtcgacctggttcggaatcacttccgaataagccggtaccagtaatacatcgtcaaacgtaataccttctccaataatcttacccatgacttcatttcctctctttctctgactgtttttagtttaaaagatatgatacataaaaaaaattgcgatgtcaactctttcttttttcttacaagatgacttttcttggagcaagcatccggatcccgtcgagaatcacctgctccggctcaaagatcaccttgatttgctgtccattcttagaaatcaccatcacatagcaacgggtattcggcatatgagaactgtaatccagcactttgcccccctgatagtgattcagctctcctgctcctcttggcgcaagtagttccagatcgttgacattcatggaaaatacacgctttctcttctgctttcccatgatcttatcgatatccagatccccgttcacatacagatactcgtattccaggtccagtctgcggaacaaaaacacgtccagcacgatcagaaggaccggaagaatcattaaaaacggcatcaacaaaacgaggaaaaaggaaaagactgtgcagaaaatcagcagaatcttaatcacaatatctttcccatccgctttctttttcactaattgttctgtgtagtaatcgctcatacacgtttcctccatctgtttattcctatccagtatatcattttacgaacaaaaagaaaactccccttgcgaggagttttctttttttttagatttacatcattcccatacctggatttcctgccggtaccggtgtttcttctttgatattcgcaacgacggattcggttgtcagaagagtagatgccacgctggttgcattctgtaatgcgcttcttgtcaccttggccggatcaagaatacctgcctctaccatgtccacgtactcttctttgtacgcatcaaatccgacgcccggttcagactctctgactttgttgatgataacagatccttccagccctgcatttgccgcaattctgaataacggagcttccagtgcctttacgataatgcgggcacctgtcttttcatcgccttccaattcgtttacaaggtcttccagagctttggttgcatgtacatatgcggatccgccgcctgcgatgattccctcttctactgctgctcttgtcgctgccaatgcgtcttccatacgaagctttgcttctttcatttctgtttctgtcgctgctccgacacgaattactgccactccgcctgcaagttttgcaagtctttcctgcagcttctctctgtcaaagtcagatgtcgtttcctcaatctgagccttgatctgagcaatccgtgcatcgattgcggatttttctcccataccgtctacgatggtagtgttttctttctgaacctttacggactttgcacgtccaagctgatccagtgtcgtctctttcagatccagacccagttcctcagatatcacttcaccacctgtcaggatcgcaatgtcacgcagcatttcttttcttctgtcaccatatcccggtgcctttaccgcaacgacattgaacgtaccacgcagtttgttgacaatgagtgtggtgagagcttcgccttctacgtcctctgcgataattaaaagtcttgctcctgcctgaacaacctgctccagaagtggaaggagctcctgaatgttggagatctttttatctgtgatcaaaatgtacggatcttccagatttgcctccatcttatccatatctgttgccatatatgcggaaatgtatccgcggtcaaactgcataccttctaccaggtccagctctgtcttcatagtcttggattcttcgatggtgatgacaccgtcgttagatactttttccattgcgtcggcaaccatatttccaacttcatcatcactggatgatacagccgctactcttgcgatctgtgctttatcttttaccttgctgctcatctttgcgatttcttctacagctagatctgtcgcctttttcataccctttctcagtacgatcgggtttgcgcctgctgccaggtttctcataccttcgtgaaccattgcctgagcaagaacggttgccgttgtcgttccatctcctgccacgtcgtttgtcttagatgcaacttcacgaataagctgtgcgcccatgttttcaaatgcatcttccagctcgatctcctttgcgattgtcacaccatcatttgtaatcagcggcgcaccgaatgatttgtccaatacaacatttcttccttttggtccaagtgtcactctgactgtatcagcaagcttattcacacctgtttccagcgctgttctggcttctgctccatatttgatttcttttgccatttctaatccctccataatgatatttcaaattattttctgtctgatttaggcttcaatcactgcgagaatatcgctctgtcttacgatgatatattctacatcgtcaagctctacttctgtacctgcatattttgaataaatgactttatctcctacagacactttcatttccacttcttttccgtctaccaatccgcccggtcctacagcgacaacttctgcctgctgcggtttctctttattctgccctggaagtacaattccggatttggtggtttcttctgcttccatctgttttaatacaactctgtcacttaatggtactaatttcatgcttgttcctccttcactttctatcacttatcagcactcgttgtattggagtgctaaaacgctctagtaataaaatagcactctccattttatttgtcaacatccattcttattctttataattcgtttataattctgtccgtaacagtccagctatacacaaattcacaaaagctcaagctgtcatggccaaactgctctattccatccggttacactttataaaagccgttctggatccgaaagacgatctgatctttctcctggtcgcggaaacgtttcagaatcacaccctcacatccaaaccgtccttccttcacctcgaagatacattcatagacggcgtctagtgaaatttcatttacatcacccctgcttgtgtaaagtgtcatctcctccgcctccttgtcaaaggaacgaattcttgtcatatatttttttcgattatatttttccgcctttaaaaacacacgcttcatctgcagaactgctgctccgtcctcgtacatcttttgtttctcctttcccaaaagggagcctcagaatactgacgctccctttccttttgcatatcctactgttccaatgccttttatttttgcttttccttttttatcttctcaagctcagtgaacacatagtcgtttacgactttaatatatgttcctttcattccggaagacctggattcgataacacccgcactttcaaacttccgcagtgcgtttacaatcacagatcttgtgattcctaccctatcagcaatcttgcttgcgaccagaattccttccattccgtcaagctcatcaaaaatatgaatgatagcttctaattccgagaaggacagggtactgattgccgactggacaatgtgctcttttctcgtctcttccgcattttcttcattgactgaacggagcatctccagccctactaccgtcgtcccgtactcgctgagaatgatatcgtcgatctcatactcttcatcctgcttgtaaataaacagggttcccaatctctcccccgcaatttcgatcggagaaataatcgcctgatatccttttgccgtcgcggcatcaaatcccaatgtctgaagattgacattctccttcgttgataatacgctcagaagccgttcgttcagcatagtatcaatatgtccgcccacttcaccttcgatcagctctgtcagcggacggatcgcttcttgcttgctgattcccagaacttttccctttttactcactacaaggatatttgaattcagaatttctgtaagcacttcacagatatcgttgaaaacaactttgctggaactattattgtgaagcaatttgtttatcttccttgtcttatccaataattgtacactcataattttcctccattcaaattcacgacgttgtcccatgtaattgtacgaacaaattatagaatatgcggatcatattttaatattatcatacaattccagtattatcaatgaatttcggaaattaatttttttctttcttttccacataaccgcaggtgctgtcagaacaaaccagcctgttccccttttctaccatatagctgccgcatttcggacatttctggtcggatggcttctgccaggacataaaatcacactccggattatcctcacacccatagtaacgtcttccctttttcgtcttgcggatcaccacgtctttaccgcatttcgggcaggatactcctgccttttccaggtacggcttcgtattgcgacattctggaaaacccggacacgccaaaaactttccgtgggggccgtatttaattaccatatttctgccacattcttcacagatgacgtcggtcacttcatcctcgatcttgacttcctccagttccttctccgccacttccacggcatcttccagatccggataaaaattactgatgaccgatttccactgcaccttcccttctgctaccttatccagtaaaccttccatgtttgccgtgaagttcacatccacaatgcttgggaaggactgcagcatcatatgattgactacctctcccaattctgtcagatagaggttcttattttcctttgccacatagcgtctggcgatgatggtggagatggtcggtgcatacgtactcgggcgtccgatgcccagctcctccaacgcctttacaagggacgcctccgtgtagtgcgccggtggctgtgtaaaatgctgcttgctgtcaaactcttcttttgtcagaacagaatgttcatccagtccttttaaaaggacattattctccgccttctcctcatccggctgtacataaacagaacggaacccatcaaaagcaatcttggaagccgctaccgtaaagcggtattctcctgcgtcgatcttgacagatgtcgtctcaaatctggccgcctgcatctgactcgctacaaaacgtttccagatcaactgataaagacggaactgatctctggagagagactctttcaccatagcaggtgttctggatatatccgtcggacggatcgcctcatgggcatcctggatcttctttccaccgtcctttttcttctccgcgtccgccacgtattccgggccataggttcctgcgatataatctcttgccgaagcttccgcctcctcggaaatacgcgtggaatccgtacgcaggtaggtgatgataccgatagtgccctgccccttgatatcgatcccttcatagagttgctgtgcgatacgcatggtcttctgcgtggcaaagttcaggaccttggacgcctcctgctgcagagtactggttgtaaatggaagtggggacttctgagtccgctccccttttcttatttcggcaacctggaattgggcatcctcgagcgcctttctgatcttttcttcctcctcggcagaatgaatcaccagcttctcctgtttcgtcccataaaacttggcgcgcagaggctttttctccccctgtactttcagaatcgcatccagcgtccagtactcttccggaataaaggcgtcgatctccgcctcccgatccgcaatgatacgaagagcaacagactgaacacgaccggcgcttaatcctcgctttactttcttccacagaagcggactgatccggtatcctacgatccggtcaagagctcttcgcgcctgctgcgcgtccaccaggttcatatcaatctctctggcattcttgatggattctttgaccgcatttttcgtgatctcgttaaagctgatccggtacacctttttgccctcaagcttcaaagccatggtcagatgccacgaaatcgcttccccttcccggtcggggtcagtcgcaagataaatcttgtccgcctttttgacctctttgcgaagctgtgcgagaatatctcccttaccccggatcgtaatatatttcggctcaaaatcatgctctacatcgataccaagctggctttttggcagatcccgcacatgtccctgggacgccattaccacataattgctgcccagaaattttttgattgtcttcactttcgcaggtgactctacgatcaccagatatcgtgccataattcctattcctccatccaacatccatttttatttcaatcggatataatcattttttgaaacttcctggatccatccattcatctccagattcagcagaccctccatgatctcgcctcttgtgagggaaagctcctcctcgatcttttggatattttttggctccaaactcagaacactatacaacaatttttcaggactttcaagcattatttcattttcattggatttctcactgaattttatgagtaatttctgtaatttatacggcaaatccgagaggaattcttccggggaaatgagaatacctgctccctgccgaatgagctggtgacatccctggcttaacgaactggtgacaggtcctggaagggcgtagacgtcgatcccttgttccaaggcaaaatccgccgtaatcaaagagccacttcttttcctggcctccatcacaagtaccacgtctgaaagtgcgctgataatccgatttcggggtggaaaatttcctgccaggggcggcgtgccgggtacatactcagacagcagcgccccctttctctggagtttctgatagagcatccggttttccttagggtaacagagatccactccgcatccaaggaccgcacaatgtctgcctcccgccgcaaaagcaccctccagaccttttgcatcgattcctcttgccattccgcttacgatctccatccctgcttttgcaagctccctgccaaactcatatgccatctgcctgccataggctgtcgcgtctcttgcgccgacgatggccgccgtcacctttgaaaatgaaaaacagtccgtccctgtaccaaagaaagcgtaagggggcttggcaatcccgatcagcttttccgggtaatccagatcgccccaacaggtgaggcagatcccttgtttcctcgcccgctcccaagctctgcacttatcatccagaatcgtctctttttgctgggctttcagagtttccttctccgtttccgtcaaaaaccagcaggatgttcgtgccgtttcttctatattaaacactgccctggctgaatgaaagatctcctttaataaacgcttttttgcagaggaaatcccatgtaaagacgcaagccaatattcatactctttctctgttttcatcgtttctgattcccccatatcttctgatctaccatgcggtagctgatggcctccgccaaatgacacccccgtatctgttcgctctcctccagatccgcaatcgttcttgccactctcaatgtccggaagtacgtcctggcggtcagcccaagcatctcaaacgcacgttccatcatccgctgcgctttttcttccagacagcagaagcggcggatctcatccagattcattccgctgtttgtggcatacattctcccctgatagcgttcccgctggatttccctggcttggatcactttttttaagatgctttccgaagtcacattttgattgtccgacatcagttcccggtaggagactttgggcgtctccacgcagagatccatccgatccagaaacggctggctcaccttgctgagataccggtggatttccccgggcgtacaacggcactgttccagattgggatagttgccgcaaggacaggggttcatggccgctgccaccagcacattagccggaaaaagataagtgccttgctttctcgtaatccgcacctgctttgtctccagcggttcccgaagcgcatccagtaccggtctttgaaattccgagagttcatccagaaagaggacaccgccgtttgccagactgagctctccaggcgatggatatctgcctccgccaagcaatgccgcctttgtcaccgtgtgatggacttccctgcatggcgggcgcacaacaagtggggacgtttcatcgagaagcccagccgcactgtagatcgttgtcgtctccatactggtacgctcatccaaatccggaagaatcgtcccaagcctctgtgctgccatcgtcttcccggatcccggaggcccgatatagagaatattatgcccgccggctgccgctacctccgaggcccgttttaaaacactctgtccttttatatccgcatagttcagtctgcctgccgttcttttctctttcctaaccgaaacagaaacccaatgaggctttttcccctcttccagaaactcccatacttcggaaagggtggatactccgatcacctcgataccggggacgagatgcccctctgcttcattttcccgtggaatcacacagatctcaaacccgtgcttcctggcaaaagagacggtaggaaggatgcctttgactttccgcactttagcgtccagactgagctccccaatcatcaataccttgttttggcacctgttctcgatacttcccgatgccagtaccagcgccgccgcaatcggcaggtcaaaggatgctcctttcttgcggatatccgccggtgaaagattgaccaccatcctctgtggctggaggcgtacttttgtatgccgaatcgccgtccgcacccgctctcctgcctccttgacttcggaggacagatatcccaccatatgaaagacaggcaaaccatttcctatgtctgcctccacacagacttctcttacctcaagtccgtctatcactgctgatttaaccattgcaaatcccatattctttttctgattttccctggaaataccggtgattttccggtccgccagaacggcagatgaattcagatctgattttatggtagtctctctgtccctaaatgtcaattcttatttaggaaaagcacaaaaattctcgcgttttcatagactgatagcaaacatgttaagaggtgcgtattcccttgaaatcatttccacaacccctcacggccgacgaagaacaatactatatgcagaaatacactgagggagatctggaagcaaaatacatcctgattgaacataatctgcgccttgtagcacatgtggtcaaaaaataccagcatctttccgaagatacggaggatcttatctctatcggaacgatcggcctgatcaaagctgtaatgacctttaacccggacaaaggcgtgcggcttgccacttatgcggcacgctgtatcgaaaatgaactgctgatgctgatgcgttcccggaaaaagctctccggtgaagtctctctttacgaacctatcggaaccgataaagagggaaatgaaatccggctctttgatatcatggaatcggacgccaaagaggtagatgaacaaatttcactccaggatgatatcgggaaactctatcagaaagtggaatcagaactgtcaaagcgggaacgccttgtcctgaaactccgttacgggctttacaacgaggagatcctgacgcagcgggaaatcgcaaagcagcttggcatttccagatcttatgtctctaggattgagaaaagcgccattgaaaagctccgcaccttttttgactcctgaaaaacgaaaaacacggcgtctgctgccgtgttttacataatcgtttcttcttttattcttccctttttctcagaagatcgtatcgggacgcttctctgtcaagctttacccagagaatctgccttgcatgtggagccgaatcctgcgcctgccgctcactgtcatagattgcaagaacctttgtcgtcacatccgtcccatccggtttcataatctcgatttcctcacctactgaaaatttatttttttgctccagacgaatcaggtcatcttttgtttcctccacaataccaaggtaggtgtaattcttcaggtacgtattattgtcgtaaatctgagtttcctcgcttggctttccaaaaaagaatccggtagtaaatttccggtatgtgcagtttgcaatctgctctttgtaccattccatatgccccccataacattccgggctctccttataatcgtcgatggctttccggtacgttcttgctaccgtagccacataaagggccgtcttcatccttccttcgattttgaaactgtcaatcccagattccatcagttccggaatatgttcaatcatacagagatctttagagttgaagatataagttccccgctcattttcaaagaccggcatatactctcccggccttgtctcctcgacgatagaatatttccatcgacacgggtgagtacatgctccttgattggcgtcccggccggtcaggtaattgctcagaagacatctgcccgaataagaaatacacatcgctccatggataaaagtctcgatctccatatccttcggaatctgtcttctgatctcccgaatctctgccagggaaagctcccttgccgtcacaacacgctccgctccctggcggtaccagaacaggtatgttccataattcgtgttgtttgcctgagtactgatatggcgcggaatctccgggcagacttcttttgcaatgtcaaagacacccggatccgcgataatcagcgcgtccggaccaatttcctttaactcctgaaaatactcccgcaccccattcaaatccgtattatgtgcaagaatattcgcagtcacatagacctttacctggcgctcatgggcgaaagcaatcccttctttcatctcctccatggaaaaattcttcgctttcgcccgaaggccgaaagcttctccaccaatataaacggcgtctgctccgaaaatcactgcggtctttaacacttccagactgctggccggtactaataattccggatagcgcatcttattcactccttcttgatactgacagacgccccgtccccgatcggtacgacggctgtctccagtcgtttgtcatgtttgatcagatagagatactctctcattcgactgtgaatggttcgatcacggcgttccacggcaaaccgtgactccatgatccctccctcctgcagtacattatccgagatcagcatcccgccttttttcaaaagacgtatcacctctggaaaataggagagatactgagcctttgccgcatcgacaaaaataacgtcgtaaggcccggacagctttcgcatccactccatggcgtccccttctaataggtgaatccgcccttccttcccggcacagcggatattttcctttgccttttgaattcgtttctcataattttcaatcgtatcgatgatacagtcttcttctgtatattcactcatcagaatcgcggaaaacgcaacagcggttccgatctccagaatccgctttggccttttcaaaagcagaagcacttttaaaaagctctgcatttcctttctgataatcggaacccgctcttttagtgcttcctgctcaatcgtctccagtatatcactgtttcgcgtttccagtgaatgaatataatcgacgatcctctcatccactatcatcgttcatttcctctttatacattcacatccataatgatcggaaggatcatcggtcttctcttcgtccgtttccagatgaactcattcatcgtatcccggatcaccagcttgatcttgctccagtccgcgtttctgctgtttaagcagccctcaagagctacgtttaagacttcctttgcttcttccattagtccctcggactcccgcacatagacaaatcctcttgatacaatgtccggtcctgcaagaagctggttcgtacccttggcaagagtcagcacaacgatcaggatgccatcctccgccagatgctgacggtctctgagaacgatattcccaacgtctcccactcccagtccgtctaccaggatcgctccggtctgcacatgaccggctactcttgcacccttgtcatcaagttccaacacatctcctgcctgaagaatgaaaatattttctttcggaattccaagctgctccgcaatgcccgcgtttgctttcatatggcggtactctccgtgtaccggaatcgcatatttcggcttcacgagggaataaatcaactttaattcctcttggcaggcatgtccggatacatgggcatcctggaaaatgacattcgcccctttggcagaaagctcattgatgaccttggatacagacttttcattgcccggaatcgggttggaactgaaaataacggtgtctcccggcataatggtcactttcttatggatatccgccgccatccgggaaagagccgccatggactcaccttggcttccggtcgtaatcaataccgtcttttctggcggatagttcttcagtttgtcgatctcgataagcgtgttcttcggaatatccaggtagccaagctccgccgcggtggagatgatattgaccatgctccgtccttccacgactacctttctgccgtacttataggcagaattgataatctgctgcacccgatccacattggacgcaaaggtggctatgataattctcgtattgctgtgctccgcaaacaggtggtcaaaggttcgtcccaccgtacgctccgactgggtaaaccctgcacgctccgcattcgtactgtcagacatcagggcaagcacacctttctttccgatctccgcaaaccgctgcagatcgatagcatccccgaacaccggagtataatccaccttaaagtctcctgtgtgtacgacgattcccgccggggaatagatcgcaagggccgatgcgtcctgaatactatggtttgttttaataaactcaatgcggaattttccaagattaatagactgtccgtgccgtacgactttgcgcttcgtacttctcatcagattgtgttctcttaacttattttcgataatgcccatcgtaagttttgtcgtataaatgggaagattcatctctttcaagatatacggcagcgctccgatatggtcctcgtgtccatgggtgatgacaaaccctttcacttttgagatatgatcccgtaaataggtgacatccggtatgacaagatcaatcccgagcatgtcgtcctccgggaaagccaaaccgcagtccaccacaataatactgtcttcgtattcaaaggcagtaatgttcattccgatctgctccagtccgcctatcggaataatacgcaattttgaattgttcgttcttttcaactttacacctccattattttttcgtccgctcattctctgactggtatttaagatccgcaaaagcttacagctcgatccctacatcttccagaagctcttcaaacaccttcgatacggcctgaagttccacttcgtcctctacgatctcatacagggcgtcttccccttcgcttttactcttctcttttaaaatcagacactcggcatctccttcttctctgtctgtcacaagaatataggaaaaccctctgattttcgtctgctccaacacatagaatgatgccggcttatccgaaccttccggcataaacataattttttccattctaaactcctctcataccaacggaatccagatatccctgcagtatgaatactgccgcaattttatctatatagcgtttcctctcttcccggcgcacaccactctccatcagcactctctcggcagacactgtcgtaagtctctcgtcccacagatccacttcaaggcccgtccttctctccagcatctctttaaaagagagcgtcttttgggcacgctcgccgacatcattattcatatgcttcgggaatccaaggacaattttttccacctcaaatttgccggcaagagtctcgatcctcgccagtgtcttcctcagcttattttcctgcgtccgtgtaatcgtctcgactccctgagcagtcagacctaagggatcgctgatcgcgactcctacggtctttgctccaaagtccagtcccataaccctcatacttactcccagccgttatgctcaatatatgccttgagcatctcttcgaccagctcatctctttccatcttcatcacaagacttcttgcaccattatggctcgtgatatatgtcggatctccggacatgatatatccgaccatctgatttaccggattgtatcctttctcacgcagcgccttataaacgatctcaagaatatctcttgcctgaatctgcgggccctggcccacctggaaaaattgtgtgtttgataaatctttcatcgttgcgacctccaatactactactctattctaatataatcccacctaaaattcaatccataatttgtaactcaaccattattcagccatacggccgaaaaacaataaggtctgaagcaaatttgcttgctgaaccgttactcattccccatggtgagttctacgatctgattttcccgtgtaccatcggccgttacctcaactttgacgtattcttttgtaaagcctgtccggtaaagaattccctccctttcaacggtctcttccaacaaaacttctacctttcttccgatcataccgtcttcaaattctttcttcttccgctggcagagatccagcaggatctgacttcttttagccttctcctgatccggcacctgatgcggcatctgggccgctttcgtcccgtttctcctggaatatttaaagacatgtgtctcataaaagcccactttttctataaatgcccgggtggtctcaaattcttcatctgtttcccccggaaatccgacaatcacgtctgttgtaatagccggatatgcaaaatactttcttagcatctgacacttttcaaagtactctccgcttgtataatggcggttcatcctcttcagagtagtgtcgcatccgctctgcatggagaggtgaaaatgcggacagaccttcggaagctcagacagtgattttgcaaagttctctgtgatgatacgcggttcaatggagcttaaacggattcgccggatcccgtccactttatggatctgtcggatcagatagagcaagtcccatttctctccctccatgccagcccacgtctccagatccatcttcgggtttacaaagtccattccgtaggaacttgcgtggatcccggtcagaaccacctcctgatagccggccttagcaagccgttctacctcttttacgatctcctccggcttgcggctacggattcttccccgtacatacgggataatacaataggtacagaactggttgcacccatcctggattttgatgtaggctcttgtatgatccccggcagaatccacatagagctcttcaaactctccggtgtgattgatatcaatcacagcttttacatcctcatgctgttcatagtcatggagcagtgcgatgagattcttcttctggttgttgccgatcaggatatcaattccttcgatctttgtccccgcctcctcctgggcctggacatagcatcccgccgctacaatcacggcgtccggattgagttttctggccctgtgaagcatctgcctggattttctgtctgcaatattcgttacggtacacgtattgatcacatacacgtccgctttttcatggaatgagacgatttcatacccgtcctcctccaaaagcttctgcatggcttctgtctcatatccgttgaccttacatccgagattgtgcagcgctgcttttttcatttttttcctccgtccttttctaagttttataaaatatgacgaaatttcttcccattctttggcaagttgtttcttgactttttaattgtactatcataagatattcatataaacaaagagagaggagtgtgtttccaatgaaaacagtcaagatttcattaaactcgattgacaaagtaaaatcattcgtaaacgacattacaaaattcgattatgatttcgatttagtatccggcagatacgtgatcgatgcaaaatccatcatgggtatcttcagtctggatttatctaaaccgattgatttaaacattcacgctgacgcaggcgctgatgaagttttagaagttttaaaaccttatcttgtttagatgaaatcgaatcccccacggagaacgcgggggattttttcataggaaactacattacctaaggttcccctcttctatccttcgacctcgataatttctgtcgtctcaagcgccgcttccacaaggtggtcgatatcttccgaaaggcgctgttcggaacgctgaatcacatccagtttcggctttgtcaccggatgtttggcaacaaagatcgtacaacagtcctcatacggaagaatcgatgtctcaaacgtatcaatcttttccgaaatctccacaatctcctgtttatcaaatccgatcagcggacgatacaccggaagggtgcagacctcgtttgtcacaaggagactctgcatcgtctggcttgcaacctgtccgatactctctcctgtaatcagtccgaggcacccgcactttttcgcaagcgtctccgcaatccgcatcatatatctccgcatgatgatcgtcaattcatcgtgcggacatttgtcataaatagaaagctggatatctgtaaagttcaccacatgaagccggatcggcccggtatacgcagccaccttttttgccagatccacgaccttttgcttagcacgctcgctcgtatacggcggcgcatgaaaataaaccgcatccagcccgacgccacgttttgctaccatataccctgcgaccggactgtcaattccgccggaaagaagcagcatagctgttccgttcgtaccaatcggcattcctcccggtcccggaataatgtgggaatagatgtatacctcttcccgtacttcgacattcaaaaggacatccggatgatgtacgtctacccgcatctccggaaatgcgtcaaggattgcttctcccagatcacagttcatctccatggagttgacagggtaggtcttctttgcacgccgcgattctaccttaaaggtcaggttcttatccggatacgctttctctacataagcgacaatgtcctttttcagctcctcaaattccttcacctctgtccgtacgaccgggcagatgccgacaatgccaaacacttttttcagtgcctccaccgtctcctcatagtcataatatccatcacagtctacgtagatgcgtccctgacatttgtggacacgaaacgtaccttccgcactccggagagcaaaacggatctgacgcaccagtgcgtcttcaaacatgtatcggttttttcctttgatcgcaatctccccgtactttatcaaaaaagtctgatatgtcattctaatctcctttatctccgtctgtatcttctaagcatcggtatacaattatataatgttttaagcgtatagtcaatttcttcttctgttgtaaattccgaaagactgaaccgaagtgtcgcatccagatattcccgttccactccgattccttttaatacgccgctgattccaggatgattcgaggaacatgcggatcctgaagatacataaattcctttttcttccagcgtatgaagaagcacttcacttcggacgcccgcgatcccgacgcttacaatatgcggtgcgctggtctcgtctgccagaccgtgtacggacacgtgttccatcttagtcacgccctgaatgaaccgctcttttaagtttcgcatccgcatcgtcttttcttccagattagtgtaggccattttggccgccagggcaaaccctgcgattcccggcacattttccgtcccggagcggatattcttctgttgttccccaccgaagacaatgggacggatcttcacccggtcactgatatacagtgcccccatccctttcgggccgtggatcttatgactgctgatagtcagaagatcaattccctctctctttgggaagatccggtattttccaaagccttgtaccgcatcggaatggaaaatgatctcccggttgtatgccttgacaatgctggaagcttccttgattggctggacacttcccacctcgttattgacgtacataatagaaacaagaatcgtctccttacaaagtgcctcacgcagagccgatagcttcactcttccataacggtcaaccggaaggtaggtgacacgaaatccctcttcctcctccaaataccgcatggtattcaggatagccggatgctcgatcactgtcgtaatcagatgattgcctcgtcttttgtacgctcttgccgtcccgatcagtgcaaggttatcgctttctgtcccaccggaagtaaagaaaatctctttctcctgcacttttagaatccttgcgaaagtctccctggcgccgcgtacataccactccgcctccattccttttctgtgcagggaggatggattcccatagtcttcacacatgactttgcgaaccagatcgcccacctcgtcaaatgcttttgtcgttgctgaattgtccaaatatacttccatcagttcttacctttccaccttttttattaccatatgttttccaccgggttcttgacacctggttttacggttccattagatatgagaggactgaaagtacaaataatccggctgtctccgttctgagaatccgttttccaagagtgactggaacagctcttgccaactccatagcctttcccacttcctccacctcaaatcccccctccgggccgatcaaaataccgatggaccccccggctctcagagaggaaaactgccgtctcgtctcttccattccctcagcaagctcgtaaggaatcaggacgtgatccagtgtgccggcgtaggtgagagcctctgaaaagcccatgacctgctttacttccggaatcttacccctgccagcttgcttggccgcgctctcagagactgcctgccagcgctccgtcttcttctttgcctttttttcgtccagcttcactactgcccttgctgttgccatcggtacgatctccgaaacaccgagctccaccgatttctgaacaatccagtccatcttatcgctctttggcaacccctggaaaagtacgatccggcaagatgattccgtatccgtacagaaagtttccaaaatcttgaccctgacgctctccttcgtcatctcttccaccgcacagagataattttgattgttcccgtcgctgattttcaactcttctccgattttcatgcgaaggacattgcaaatatgattcacatccgctccggtgatccaaatctccttgtcacccacctggtccggagtcacaaaaaaatgctgcatcgtagattctctcctatctgttactcagactttctggccgtaacacagacccactctccctggtaagtcacatctaaaagctccaggccagcatctgctaccgcctgttttacaacttcttccttgtcgtcgatgattccactcgtaatgtaaatgccacctggctttaactggctgacaatgaccggagtcagcataaccagaacatccgccagaatattggctgccacgatatcataacatgcgtatccaacctgatcctgaatggccttatcatctatgatattgccgatcatcacctcatactgttcttttggtacgccgttttctttcatattttcgtgggttgcgtcgatcgcgcatggatccaggtccgtcccaaccgcataggcggcaccaaattttaatgctaacattccaaggattccgcttccgcatcccacatccagaatccgcgtcgtatctgtcacatactttttgatctgacggatgcaaagctgtgtcgtttcatgcattccggtcccgaaagcagtgcccggatcgatgtggataatcatcttcccctcatcctccggtttcacctgctcccaggacggaataatcaggatatcatccacatagaactgatggaaatactgcttccagttgttgacccaatctacgtcctcagtctgggattcctcaatagtacatggacccaaatccacaaattcccgcatcccggcaagttcctccaaaaccttggcaagaacagcgtccttatcctccccttcttccagatagaaattgataaatgccgtcccatcatccggtattgtctccggaagaatatcgacaaacatctgctccttttccttctgtgtaagcggaaccttgtcctcaatctccactccctcgattccaaggtccgaaagaatactgctaacaatatcctctgccgcagtagtcgtctttaatctgaatttattccatttcatcttgtttttgtctccttattctcgtgctgcacacttcatcctgtcacacagtttccggcaggccaaaagtaggatggaggcatgatcggacgccaacccgcctcggttcttaatctcaatccgttgttcccggatcagcgtcccgttcgtcaaaactgtcagcttaggacgcaatatcacaccattttgctcgttttgaagctctatctgataccgaagcttttccccttctttttgcctgttcatcgtgattgtaaaccacgccgcgtcactggcatcatctccggccttcgcctccacctcatcgaggcagacaagcgacataaaggcagttgtaatcacccttgctcttggatcccgtctcacttctccaaagacaccgatctgctctgcacagacgttccgaatattcgtttcctcaaaaagctcccgtttagcggatacttccagatcttcttttaactcaataaaccctcccggcagggcccagtccccgatgctaggatgattcttccgacgaatcagaaggatcctgagatcctccagattctcaggatctttcccggaataaccaaacaccgccatatcaaccgtgcagcatggatttttatatcggtatggatcgtagttctccaaaaattcctccagtgtctctcctttttcgtttctgcttccgtctccccggaacacttcgatgtcctgaaaaaaggccggcatcttctcacctgctttctctgtctcctggctttttatcattctgctattcttttcatcttttctagcggcatccttcaccaaccatgatatcgatgatctccacgttggtctctctcatcccttctttccccagacgtccgatatttttgatcgtctcatctactcccttggtcacgataccgtctccggcgtagaactgctgtccgcacttgtacatattatatccaaggattccggcctctacagaggacgcgatcttggccgcacaggatgctttcgctccatcacaaacaatgccggatacaatcgccaacgcattgacaacggtgtgggcaatctcttcatatcctccaccgtacaggtaggcaattccagctcctgcagccgcccccgcacagacagcgccgcagtacgcagagagcctcccgatcccggtcttctgatggatcgctaccaggttcgaaagggtcagcgcccggtagagctgttcctcgcttgcgttcagttcttttgcatattcaataaccggaagcgaacaggtcatcccctgatttccgcttccagaattgatgataaccggaagttcacagccattcattctggcatctgatcctgcagccgccatcgcttttgcacggacacgaatattgtctccctccatcattaagagaacgcttccgatattggcaccgtagtctccttccagaccttctttggcgattgccgtattgtaggcgatctgacgtccaatcacttctttgacatcttctacatccactgtccgggcaaaatccaaaatgtctttcatatttaaaagggagcggtccgtaagcccttcttctttctcgccctctaccttttcttccatgagaatcttaccgtttttctcaatcaggactatattcgtgtggtagtttgcgatccgtacagtcgcactggattcccctttactttctgttacaataatgtcaaatgtaattccgttatctacatattccactgtgatctctgtattctggaggaagtctttcatctcctcaatctctgtcatggagacatccgcaatgacttcgagttctttctccggacgtccggcaatgatgcccgcggcggctgccgccggaatccctttcagatgatccgtgtttggcacaatcacagatttaacgttcttaataatacttccacttgcgccgatccgcactttatccggcttttccccaagaacttccctcgccttcgccgccgcataggccagtgcgatcggctcggtacatcccatggccggaaccagttcctcctttaaaatctgtacatacgccccatactttacatcttcttttttcattccattcatcctctcttttcttttggattatatgtgatttcaggccttccccaataagtaatcgataaactgctgtgctgtcctaccggatctgccgccatgggtcatctcccactgattcgcttgtagcagaagctcacttttctccatctggatctgattacgctttgctaactccaacacaattttctgaaattcctttttatctggaccgacaaagaaaatcgatactccaaatcttgccacaagagacagtttctcctgtaccgtatccgatgtatgaaggtcgtcgtctcttctgtcgttcttatcactccactgttctcttacaagatgcctccggttggaagtcgcatagatcaagacattttccggtttgcgctctaaaccaccctcaatcacagctttcaaatatttatattcaatctcaaactcctcaaaggacagatcgtccatataaataataaatttataattccggtttttcacttgggcaatgatatcgttaagatcctggaactgatgcttatacacctcaatcatccgaagtccttcctcatagtactgattcaggatcgccttaatagatgtggattttccagtgcctgcatctccgaaaagcagacaattattcgcctttcttccccgaacaaaggcttccgtattttcgatcagcttcttcttcggaatttcataacccaccagatcatcaagccttacatgggcaatctttgtaatcggcacaatcttcgccccctcctccgtgtgctctacacgaaatgccttgtgaagtccgaactttccgacgccgaattccttatagaactgggtcatcacctccttaaaatcccgaggcgtttttgtttcggcaagatgaactgccaatgtacaaatccggtctcggattctgcggttgtagacatgcccttcctgtttggtccctttgtaatcaaaaagaagctcgtgtgctgtcgcaccaaggttccttccaagctcctgtacatcgtagtcgaacagctctttcataattacgaaatcatggagcgctacctcattgatactgccctcgatcatgccacggatctcacaggccgtactgtaggcattctcatcattcaccagcagaaaggtcaggtatgtgtgccagagattcccctccaggccatgctgttccgaaagttccaaaatcccgttgacacattcaaaaaacagtgtccttaaatcttcctgattgtaatagccactcccctcatgctctatcagaaaggtcatgtcccgcagaatcttcccataatccagattccggtatatcatcagttcgtttgtatgcatcttctcttccttctttttctaattctaataatttcccagtatcttcatgctggtcgtctcctcgcgcagtccccggatggcgcttttaactcctccgtcggcaagatttccttcaaagtccacaaaaaaccgatattcccacggccggtcttcgatcggtctggactcaatcttggtaaggttcaggttattgaagataaagtgggacaacatctgatacaaagatccgctcttatgtggaagctcaaagcagatactgatcttgtccgcgttttttagaaaaatcttctgatttgtcacaatgataaagcgggtggagttgtgcctgctgtcattgatctgttcacgcaaaacttccagcccgtttaacgatgccgcataggcgctgcagatggccgcatgacttttgtcctgctcctccacgaccttgcaggccgcaaccgcagtatttggcacgctgaccttctccatcgccggatgatcgtataaatatttctcacactgcatcagtccctgtgggtgggaatagaccctcgtaatctcctcctcaccgcttcccggcagtcccgcaagcacatgattcaccggaagcaccgtctccccgacgatatagttctcatactctacaagcaggtcatatacctcactgaccgctcctgcggaggaattttcaatcggaagcacggcaaaatccgctgccccatcctcgatcgcatccatcgcatccttccacgtacggacatggtagctgttgaccgcatccccaaagtactgctttaaggccgcctcgctgtaagctccctccacaccctggaatacgatccttgcttttttcacttccaactgatctacttcgataaatggaagtctccctgtcgtcccgcaccgtgaaagcttctgatactgaagcttcctgctcagtgacatgagcagggtaaaaagctcctgcacaccctttttattttcctcatgctctacctgcgaagccgcctttgcaagcttctcctgctcccgctgccgatcgtagactttccgtccgtttttaatcttataatctgccacacaagaacaaacttccatccttctttcatataaagcgatgatctgctcatccagtcgatccagctcaccgcgaagttcctctaacgatgccatctgcgtcctccttcgcttaaactcttccatattataatacatttctgttacaaaatctacgttcatattggaattgactgttgaaaacagaatcattttattatattattagaagagctaggtaggaagaggaggatgtaatatgagacatttaatgagtccgctggatttctcagtggaagaactggataagcttttggatctcgccaatgatatcgaaaagtatccggaaaaatatgcacatgcctgtgcagggaaaaaattagccacattgttttatgagccaagtacccgtacccgtttaagccatgaagctgccatgttaaacctgggcggaagtgttcttggcttttcttctgccgattcgagttctgccgcaaagggggagagtgtatcggatacaatccgtacagttgcatgctatgcagatatcgttgcgatgaggcatccaaaggaaggtgccccgatggttgctgccgcccactcttcgattccaattattaatgccggagatggcggacatcagcacccgacccagacactgaccgatcttctgacaatccgttccctgaaaggccgacttggtaatctgaccatcggactttgcggagacctgaaattcggccgtaccgttcattccctgatccaggctctggttcgctatgacaatctgaattttgttctgatctctccggaggagctgcgtctcccgacttacatccgccacgatgtactcagacgcaaccatgtcccttataaggaggttgtacggatggaggaggcgcttccggaactggacatcctctacatgacccgtgtacagaaagagcgtttcttcaatgaagaggattacgtccgcatgaaggacttctacattctggacaaaaagaaaatggagcttgcaggaaaagacatgctcgttcttcacccgcttccaagggtcaatgagatttctgtggaagtcgacgacgacccgcgtgcagtatacttcaaacaggctaaatatggtgtctatgtgcgtatggccctgatcctaactcttctgggcatccacgtcgactgatctgtgtatttgaaaggagctattgaaaatgaataatacattgaatatcgggcgcatctctgatggctttgtgctggaccacatccaggccggaaaaagtatggacatttacaaatacctacgtctggacaagctggactgctgtgtagccatcatcaagaatgccaaaagtaataagatgggaaaaaaggacatcatcaaaatcgaatgtccgctggaaaagattgacctggatattctgggctttattgatcacaacatcaccgtcaatatcattgaaaatgaggagattgtaaataagaaatctctgacacttccgaaggagatcaccaatgtaatccgctgtaaaaatccacggtgcatcacttccatcgagcaggaactggatcatgtattcattctgaccgatccggagaaggaagaatatcgctgcaagtactgtgaagagaaatatcacagaaaatagacatccgttcagaattcgcaaaacagggagggattacctccctgtttttttgcaatggctatgagctaaattccgtgcctagaggagcccttggtgttcgcttctattctcggaatttgcattttttaggttcatttattcagttttgttttaaaatgctacaatttgtatcatatcttgactttctttttcctccactttttatataaagattatgtaagcttccggttcatacaaggaggaaaataaacatggcaaaagaagaaacaaaactggtactgttcttgaaatctatcggaatatcaggacgttacaaaggattctattacctgaaggaggctgtctttctcgtccttcaggatgagcactgtctgtgcaaggtccaagaaaatatctaccggcccattgccgagcgcaatcatgtctctctatccagcgtggcaagggcaatccgtaccgtctgtctcacagcatcgacaaatgaaacgcagctccggaagttcttcccgaattattcctttcacggtacgctctatccaaaagagctgattgaacttgcggctgactatgtccgctatcactaaaacagaacacaaaaaacgaatgattacaatgtaagatcgacaattctgccaggaagcttattaaaaaggtgcggtttgcaccgcaccttttgctttctgtatatatgacaggcaggacgataagccgggttatgtcttgaacagtcatctatctagctccatcgtcgccgaaggagtccatcaacctacctaaaacacgacgggccgccgtatcgttttcattcggtctttcttcagatggggtttacatatgcctttcctgttaccagggaagcggtagtctcttacactgcctttccacccttaccgcaaaagcggcggtttatttctgttgcactttccttggagttacctccaccggacgttatccggcatcctgccctgtgaagcccggactttcctcgtctgccccctttcgggctctacagccgcgactgtttatcctacctgcctgtaataccttatcacaatctgccctctcttgcaagcccttcatctgcaatccttcctgacccgtctgccgccgatgtggcaagtacgtcgcatcgttcgttctgaggatggccgtcatgaccttttacccagataaaggtcatccggtggggcttggccgcctccagaagccgcttccatagatccgtatttttaacagtctcattctttccccgtttccaaccctttttgatccagttgtcaatccagtgctggttaaaagcgtccactacatatttggaatcggaatagatttctacttcacaaggacgattgagcgcttccaatcccgcgatgaccgccatcagctccatccggttgttggtagtcttttcgtaaccttgggaaagctcccttatatgcgtctgccctttcgaatccgtataggagaggatcgttccgtatcctcccggtccatccggatttcctcttgccgcaccgtccgtatagatttttacaagcatttatgtttctcccttctgtccatgaatctccacggtctgtccctcttcccacacccggtgaatccggttccggtaactggcagagatctcagaagtaagcagacgatccgtcaatccataatctctccacatatgcattgggaacacatggtttaccctgacgttccgcataaaaaaatcgataccagagaaggcggcgcctccctgtctgggatccagtacgacaaaggccagatcgatcttctttcttacaagctttctgatctctctttgataatctttccgcatctgtctgttgtaatcgatgctctcttcctcccagtgccaccagttcagatctccggcatggtaaatccgcttgtccttgcaggtaactaaaaatgccactccctcgtccgtggaccttagtgtctccactttcagttctcctgtccggatcttctgctccggctttacaaaaatccgattaggcgccggctctgcctccacgtcatcggacaggatgtacaggatgttcggatgttccttctcccaatcaaaaatctcagaattatagtggtctttgtgtctgtgacttacaaaaacatacatctgcttttcttttgctatcacaggcagctctcctttataatagtcgaagacatacagcgcctgctcgtcctctattgcaaatccgctatgatacaggtatgtgactttcatttgggccttctctctcctttcagcagattctgtatcctttttcgtaactctttcaccttcttatggttgcttgcatccccggcgatcccgataaccatctcttcctcgcatatgatcgacgggaagaaaaagtcgcattgcgcggcgtccgacgcattgttaaccaagatcccttttctttggcagatcctcgcaatctcgccattcacttcaggatcattggtggcggcaaaaacaagaaactcctttccagagataagctcctgagaaaacctcctgctctcgtaccggatctgcctctccaggatccaacgccgcatctctttcggaagttcctcctccctctgcagcgcacatatccggatcctgcccccaaaaggaagcaagactctggctcttcgagcagcgatccttccggctccgatgatcaggatttctctgccttccaggctcaaaaacaggggaaaacgtaaccttctcttctctctcatttgatgcgaatcccgatcccggacatgacccggtacacttccacggctgattcggcgatcttacagccggctcttcccactgcttcccgccagatccgctcctcctgattcattggtacgatcccgcttccaatttcatctatcacgacgacggagtccggatgctcttttaccaatctctctgtctgacagatcggatcgagcccttcccgaatccagtctcgtacctgctcttcaaaatgtacgatccgttcccgctccggaaatctcatcactgcaaattctgtcttcccctgaaaacttccgcctgtaatcaaaatcatgtccgatccccctctttctctgacagaacaagtataccacaaagaagcctgtacgttcaccaagtttttcaacttttttgtacaggcttcttttctcttgtcagatgataatacagacaatcccgccgttgctgtcgtttacaatcttctgcatggtgttctggagctttccctgacattcgtcgttgatcattgtaatcttgtgcttcattccgtccattaccaattcctcgatcgtctttccgaagatattggtctcccagactccgccctccttctcctttgcctcccggatataacggataatatcctgggcctgctgttcgtttccgacaatcggagcgatttccgtctcgatattggcacggatcatatggatggacggtgcttccgaatggattttcactccgtacttgcttccctgctttatgatctccgggtctgtaagagagatttcctccttcttcgggctgacgactccatatcccctggccctgacgctttccatggcgtcttttacattggcatattcagacttaagaagcgacatctctttcatagcttccagaagctcatactcattttgaatctgcatcccggtcatctcactgagcatttcataatagtatttctcatacacacggatttccattcggacgcaccccgtgtccatggcgattccgtccacgcggaccgtctcaatatatgtattctctggctgttccatcccaccgataaagtccctgatctctgtcttttcctccatcaccccacggatataggcgatcatctccgccttgatccggtggtctcttggaagcatctccacccatttcgggatgaaaaactccatctctgacactggaaattcaaagagaatctcctccatcattcggtgaatgtcttcttcttttaactgctcgcagttgaccggcatcgccgctacctgatacgcctcctgaatctccttgactgtctgggctgcctcgtttccgtacggtcttgcggaattaacaagaacaagaaacggcttaccaatttcctttaattcccgaatcgtcttcccctccggctcgcggtatgcctctcttggaatctccccgatcgttccgtctgtcgtcacaacaatcccgatggtagcatggtcatggataacctttctcgtccctattccagccgcctttgtaaatgggatctcatagtcaaaccacggcgtcttgactttcctctcctcaccgtcctcgatgtggccttgcgctccctccgtcatatagccgacacagtcgatcagacggactttcacccgtacatcgtctgacagtacgatctccgccgcttctttcggaataaattttggctccgttgtcataatggtcttccccgaagaagactgcggaagttcatccagcgtccttgccctctgattttcatcccccatatgcggaagcactaaaagatccatgaaccgcttaataaaagtcgatttcccggtacgtaccggacccacgacgccaagatagatctctccatttgttctgacctgcatatcgtgataaagttgaaatttctccatgaaaatacccccttgcaatgctgataccaatgtatgcctgcaagggggtatttagacctgttttattttgtatcacttacttcattatcccaagggagggcgccgtgctcatctttgcgatctcgcagcatcagctctttcactgcctccgccgcactctttccctcaaaaagtactgcattgacctgctccacaatcggcatggaaacctggtactgcaaggccaatcgtttggctgcctttgctgaatagacgccttctactaccatcttgacctcgtccatggcctcctgcattgtcctgccctgtccgatcagatagcctgctctgcggttccggctgtggacacttgcacaggtcacgatcagatccccgatccccgtcaatccggtgaatgtctcgatctttccgcccatacggactcccagtcttgcgatctccgcaatgccccgtgtaatgagggctgcttttgtattgtccccatagccaagtccgtctgcaattcctgctgccagagcaatgacattctttaaggatccgccaagctcaatgccccggatatccgggcttgtgtatacacggaagacttcactcataaaggctttctgaaggtattcggccgtctttctcgtccgtgctcctacgacacaggtggtcggcagaccctttcctacctcttcagcgtggcttggccccgagagcacagctacatctgcctgtgggatttcctcttcgatctgctcgcttaatgtcatcagcgtcgtctcctcgatcccctttgccacattgacaaggatctgtctgtctgaaacatacggccgcatcttctgtgccgtggatctcgtaaacggcgacggaacagcgagaacaacaaagtccctgccttgaatcgcctggtcaatcacattggtaaaccggatcgtatcctggagcctgacacctggaagctttgtcttatgctcccgctcctgatcaagcatctccacctctcttgcgtcgatggaccagacagtcacttcatgtccattgtttgtcaggagccaggaaatcgccgttccccaacttccggctcccataattccaacttttgccatactgcgcctcctattttttctttccaaagctgattttattttccgtgccgttcatcagtctctgaatattggctctgtgtttccagatcgcaagaagcgccaggaatccggccaccgcatacatttcatagaggtacacagactccatcccgtagcttcccgtctgcccccgaaacaccacaccagcaaagaaaatcagaacgaccgcaatcgaaccaacggaaacgtatttcgttactgctactattgtaacaaatactacaagtgctatcaaggtaatccaaagattcgtaagcgctgccagaagccccgccatagccgcgattccctttccgcctttgaatcccagataaaacggaaaattatgtccaagtactgctccaagccccgcatagatggaaagaagcggtaagatctccccgtaattgcctccaaaaataaggcgcaccgccagtacggcaaaaatacacttaaaagaatctcccagaaacgtacatacccctgccttcactccgagtgtccgaagtgcgttggtggagcctgcgttgccgcttcccatcttccggatatccacatgattcatccttccataaagatatcctgtctggaaaaggccaaatatatacccgatcaaaatacaaacgatccgttccatgatttatttctccttttcctttctttccctgataaaaaatttcagtgaggttcctctaaagccaaaggcctcgcggattttattttccagatacctggtgtaggaaaagtgcatcaactccttatcgttgacaaaaatgacaaaagtcggcggctttacggatacttgtgtaatatagtaaagcttcaggcgctttcccttgtctgacggtggttgctgcattgcgactgcctccgtcataatctcgttgagcactccggtagcaatgcgaagagactgattctcaatcaccatgtcgatcatctcaaaaagcttatggatccgctgtcctgtctttgcagatatgtacatgatctccgcatacggcatataggaaaggacatttctgattttgccttcgtactctcgcattgtcttatcgttcttttcaatggcgtcccacttattgacaacaataatcacgcctttcccacgttcgtgggcaatccccgcgatcttagcgtcctgctcagtcacgccttccaccgcgtcgatcaccatcaacacaacgtccgcccgctccactgccgtcaccgtgcgaataatgctgtaacgctccagctcttctttgatcttgctctttctgcgaagtcctgccgtatcaataaagacatattctcttccgtcatggacaatctccgtgtcaatggcgtctctcgtcgtaccggcaatatctgatacgatcacccggttctccccgagtagcttattgatgatggaagacttacctacgtttggctttccgacaatggcgacccgcggccgttcatcctcctcctcttcctcggttttttccgggaaataggacacaactgcatcaagaagatccccgattcccagtcttgatgacgcggaaaccggattcggatccccgattcccaaattataaaactcatacacgtccggcatgaacttgtcaaaattatcgaccttgttgactgcaaggatcaccggctttctggcgcggcggagcatatccgcaaccttggaatccgcatccacaagcccctggcgcacgtcggtaatgaaaataataacgtccgccgtatcgatggcaatctgtgcctgctctctcatctgtgagagaataatatccgagctctccggctcgattcccccggtatcaataagggtaaaatcctgatccagccaggacacgtccgcatagatccggtctcttgtcactcccggcgtgtcttttacaatagagatcatctccccggccagaacattaaataacgtagacttcccaacgttcggtcgtcctacgattgcaactactggtttactcattctatctctcctttaatactgcgtctataaaatcctgtccgcttgattttacaatatctattttcacttgtaaagcttcttctagttcagagaccgtcacatcatcgaggaacacctcttccccgctccgcagcatattgcacggaagaagcagacaatccccaagaggccgtccctgtaactgtgaaatcagatcctgtccggtaatcaacccggacaccgtgatactctctccaaaaaaatcattgcggatccggtacagatggacgtcgcagttcggacattttactcgcatctgctttataaactctgccagatagtcataggccagatagcctgtcgccatggacagagagatttccctgtctgtcggttccaatttctcataactctcggcaaattcattctgtagaagccggatcatgccaacaccgttttctaattgaaggtacccgtcgtaacgctcctcctccggcatctcatatcccgcaagaatataccattcatctcctgcatgaataaaatgatagccatattcctcataaacctttttctgccatttatggattgtctcaagtacttcttttgcatcctccctcgtgaacggctccagaggatacaatccgtcccgaaaacggctaagccccaccggtaccaccgatacgctctgcagcttcggaaggtaagctgtcagatcccgaatggtgcgttctaactcctctttgtcattgagtcccttgcaaagtacgatctgtccattcatggtaatcccggcttcaaaaagcctgtccactttctttagcgcttcccccgcaaaacggttatgaagcatcttgcaacgaagttctggatttgtcgtctgaaaagatacattgatcggctccagatgataacggataatccggtcaatatcatggtcactcatatttgtcagcgtcacataattgccctgtaaaaaagacagccgtgaatcatcatccttaaaatacagcgtatccctcatcccctttggcatctgatcaataaaacagaatacgcatttgttccgacaggaccgatactcgtccatcagcccctgctcaaagtgaagtcccaagtcttcctcatagtccttttctatttccagctcccactgttctccgtccggcttttcaatcaggacaagcagctcttcatcattgacgtaataatggtagtcaaacacatcctcgatctcctgtccgttgatggaaaggagcttatctcccggctcgatccccatctccatagcaatacttccatcttctacagccgaaatcagatgttcatgtctcttccgctgtttttccattgctgttctcctttatcttcatttcttcaatttcctgcctttttcataatactaaattccacatcaaaatgcaattttttctattcctttcttgccatccccggtgaaaatggtatagaatggataaaagagacaacgttttgtctctgaaatccatgtctttttacataggagggtttatgaacatacagaaattagagcaggtgctgccggcagcccctctaaaaatcgccgctttaaaaagctgtgaatctatggggcaaaaggtcaatgactacattgtctcttttcgtaaggaatctctgaataaatacgttgattccgcactttttgcatcttacaaatgtgagaattatctgattgagcacagttgcccgcgctttggctcaggtgaggccaagggctctcttggtgaatctgtccgtggaaaggatctctttgtgatggtcgacgtctgcaactacagcctgacctacacagtcaacggtcatctcaatcatatgtcgccggacgatcattatcaagatctgaagcgtattatctcggccgcaaatggtaaggctcaccgggtcaatgtcatcatgccgtttctctacgaaagccggcagcataagcgttccaagcgtgagtctctggactgcgctcaggcgttagaagagctgatcgatatgggcgtttctaatattatcaccttcgacgcccacgatccaagagtgcagaacgcaatcccgctgaaaggatttgacaatttcaatccgccgtatcagtttatcaaagcactgttaaaggcagagccggacttaaagcttgacaaagatcatctgatgattatcagtccggatgaaggtgcaatgcaccgtgccgtttacttctccaatgtccttggtgtggatatggggatgttctataagagacgggattattccaccattgtcaacggcaagaacccgatcgtagcccacgaattcctgggcgatgatgtcaagggcaagaccgctatcatcgtagacgatatgattgcatccggtgaaagtatgctcgatgttgcaaggcagatcaaggaccggggtgcttcccgtgtcttcgtctgtacgacgttcggtctcttcaccgaggggcttgagaagttcgacgattattaccgaaccggatatatcgatcgtctgatcacgacgaatctgacctatctgccgccggagatccacaaccgcccgtatttcatcgaagctgatatgagcaagtttatggcaattattatcgattctttgaatcacgatatctccatcagctccgtactcaatccgacggacaagatccacgcactcatcgcaaagcacaatgccgagcgtttcggatctgtaaaataaaaacgcggcaggaaagagcaatcaactttcctgccgtatctttatgccatctggctgtctttgaagaatgaaagatcagaaggatgtatccggctctttccgatttcctccaaaagaatcaaccgcagactgttcttgtagtttttcttatcccgcttcatggcctctttgagttctccaagattcacgccgcaggacaccgggagtccataacttgcaagtatcttccgaatctcttcggccgtaccctctttggttagtccctgttcctcggaaatccgggtgatctgatacatcccgatagccactgcttctccgtgactctcccgcccgtaggcaaatttctgctctatagcatgcgccagtgtatgtccaaaattcaaaagcatcctctcgccggtgtcaaactgatcttcctctacaaccccccgcttaatatcaacgcatcttgtaatgacttccgtcatcttttccgcaagtctctcaaaggtacctgcctccttcagggtagcaaacaaagaagcgtctttgatgcatccgtatttgatgacttctcccattccatcgtgaatataccgctgtggcaaggtggcaaggacgtcaggatcgatcagtactttcttcggctgataaaatgatcccacgagatttttgccttcttttaaatccactgcgacttttcctcccacggaagaatctacctgagccagaagggatgtgggaatctggataaacgggactccccgcagataagtagctgccacaaatcctgccaaatctccgatgacgccgccccccagagcgacgatcagatcacttctggatagtcctgactccaaaagcttggcatagacacctggaaggacgttgatgcttttggacgtttccccgtgtggaagaatcaccgtgctgcactcccaagttgactttagctgattcagaagctctcctccatagaaaccatagacgctgtcatcggagatgactgcaattcgtttgccggaatacacctcccggatctcttccgacgcttttttgaggagtcccttttcgatcacaatatcataactgttttccccaagatttacatgtaatttcatctgattttcacgctcttttctaccatgtcttctctacaatcggtgcgatcctgcggagctgctctaacagaaccgcgtatttttccggtttcagggactgaccgccgtcgcacaaggcgcagtccggattgttgtgaacctcgatcatcagcccgtccgttccggctgccagggctgctttcgccatcgtatctacaagccaccattttcctccggcatggcttggatctacgacaaccggtagatgagtcatcttcttcagcaccggaatcgcctgaagatccagcgtatttcttgtgtaggtctcgaaggtccgcacgcctctctcacacaggatgacattttcatttccggaagccataatgtactctgctgacatgatccattcctcgtaggtggcatttaatcctctctttaagagaattggtcgtttcgtccgtccaagctgttttaacagatcaaaattctgcatattgcgggcaccgatctgaatcagatccaccttctcatcgaagatatccagatattccccagacatcagttccgttacgatcggaagcccggtctcttcttttgccctgcacaacatctccagtccttccaatccaagtccctggaaagagtatgggctggtgcgtggcttgaatgctccgccccgcagcatattggcccccgcctctttcactgcctttgccacatcgatgacctgctcctcactctccacagaacatggtccggcgatcattgccatatgaccgccgcccaccggaataccggacacatcgatgatcgtatcctcaggatggaacgcccggtttgccagcttatacggctcctgaacgtgcatgactttatcgacactttgatccacctcaaagagacgcggatcgatacggactgtatcaccaatacagccgatgatggtcatctcttctccgcggacaacatgagcttccagtccctttgtctccaccattttaatgacccggtttaaattttcctctgttgttctgggtttcagtacaataatcatatgcttttcctcctgctatatcacactcttcctgactttgaaaatcctgacaaaaaaacgtcctctgatacactcagaggacaatacaatcatcgtggttccacctcacttcacagtcatctcgcgatgactgcctcaccaggtacgctgtctccagatataccctcgcagataacggctgctgccggaaatgcctactggtcaatacgttcagcactctactccaagaggaattcggtaacactttctgtatcccattccaccttccgggactctctgtcacattccatgctgcctactacttcttttcttcgtattttcaaagcagatttataaagttgttcttatcttacttcacatcttcttatttgtcaacacttttttccacagcctcttttaccgttaatatgccggacctgatttgaattctgacttttcctttccactcgctctccagagaacttgtcagctcaccggaaagccggatccgcatcggaaaatctcctgctttcgtgccatccgcgtcgcagtcgatctcataatcctccccctcattcagatcccgtaaaagatcttcgatccggtatcccgcctgtttactaagccacgtcttcttttcctcttctcttgtcccttcttttaacacagctttcgcctgaaactccggaagcgcctcccccttccgtattgtccgtgcttctggcgtcagcacaatgactggttcctgtgctttatgaagccctggcacaatcacaaaaagaaggtacaccaccagacaaaaaacgacaccggctgcaacagcggccggcacgtttccttttacttttattcttttcctatgaaacagattctttttcgtcccttttccaagacggaatgtctctcttctcactcgtatctgacctcggtttctgtataatccgatacgattatagcgtacttttcctcctgatacaaggaaggaattcttaaaataaatgtaaatctctacgattttacttatagaatcagtcgtaccttcaggacattctcaatccgtaagagttccttttccagctctggaaaggcagtttcgtccatatcaatcatcgtgtaggcatagcgtcccctgctcttgtttgtcagatccgcaatattgacgccccgttttgccagaagcatggtaaactgcccgatcatattcggtacattgtaatgaagtactgtaagtctcgggttcttccctttctttcccatattgcagtttggataattgacggaattgacaatatttccgttttccagataatcctgtagctgacgtaccgccattctggcacagttttcctctgattcgtccgtagaagcacccagatgtggaatcacgatcacccgttcctttcccgaaagcttctttgtcgggaagtccgtcacataactgcggacgtgtcctgtcgtcaatgcttccagaagatcctcctcttttacgagaagatcccttgcaaaatttaaaagaatgactccatccttcatctgagaaagtgtctcccgatggatcatcccctttgtatcgtccaccaccggtacatgcaacgtaatatagtcacattcccgacagatttcctccagatctctgacatgatgaatatggcgtgaaagattccaggcagaatccacagacagatatggatcgtacccgtacacctccatccccaggtgaagcgcagcattggctaccagcgccccgatggctcccagaccgatgacgccaagcttcttaccttcaatctcctgtcccgcaaatcgctttttctccttctccgccgcccctgcgatctgctcctctccagcgtgtgctttcacccattcgatcccgccgataatatcccgggaggctaaaagcaaccctgcgatcaccagctcttttacaccgtttgcgttagctcccggcgtattaaagacgacgattcctttttcggcacaagtctttaggggaatattattgactcctgctcctgcccttgcgacagcttttacgttgtcaggaaacactgtctcgtgtaaggatgcactgcgtacaagcaggacgtccgcctcctccatcgactgtgtcctctgatagctctccggaaagagcgacaatcccgcctcagagacagcatttaaacattgatactgatacattacccgttctccttttcaaatctttccagaaaggtcacaagtttctccacacctgcatacggcatggcattgtagatactggcacgcatcccgccgacactacgatgtcctctcagattgacaagtccttctttctctgcctcggcaatgaatttttcatccagttctttctttcctgtcacaaacggtacattcatcaacgaccggtccttcttcttcaccgttccggaaaaaagcctgctgttatccagatattcatacagaagcgccgcctttgtctgattgcgcttttgtatttccggaagtcctcccagatccagaagccaccggaacacctttccgcagatatagataccgtaagccggcggagtattgtaaagagacttggcgtccgtatgaattttgtagcgcatcatagtcggagtcccggaaagaacatcatcagagatcaggtcttttcgtataatgacgattgtcacacctgccggtccgatattcttttgcacgcctccgtacataatcccgtattttgtaatgtctgcaggctctgacaaaaagcaggaggaaacatctgccacaagtggcttccctttcgtatccggaagcttatgaaacttcgttccgtagattgtattgttttcgcagatatagatatagtccgcatcctctgatatcggaagatcactgacatctggaatataggaaaaggtacggtcttccgaagaggcaatcacccttgcctccccgtacttttctgcctctttccaggcttttttcgcccactgtccggtcacgatatagtccgctttccgctgtttcatcaaattcatcggaatcatggaaaattgcagtgaagcacctccctgcaaaaacagtacttcatagtcttccggtatctcaagcaacgtccgcagatccctttcggcattccggatgattgtctcaaaactagaggatctatgactcatctccatgacagacatgcccgacccccggtaatccagcatctcatttgcagcttcctttaatacttcctccggaaggaccgccggccccgccgaaaaattatacactctgctcatgctctccctccctgcttcccatccagaaattccccgtcccctggaaggtatgaaaacttacttttctactaaatccccctcatcaaatacctgatcaatcgccgctcctggagcaaccatcggccatactttttcatcacagtcaatctgacagtcaatcagcactggttcgtttaaacctctcgccttctcaaagatctgcacaaactcttcccttgtagaggcacggaatgcttttgctcccatggcctcggcaagcttcacgaaatccacctggtcattgagaacggtagcggaataacgcttctcatagaacaggtcctgccactgcctgaccataccgagtacatggttattcaaaatgacttcaattactggaatctgactacgtactgctgtagcaatctcattcatattcatccggaaacagccgtcccccgcaatattcactacgcatttatccggccttgcacatttggctccgatagaagcacccagaccatatcccatcgttcccagtcctccggacgtcaaaagcgtcctcggcttcgggtatttgtagtactgtgcggcccacatctggttctgtccgacttccgtcacaatgatggcctctccctttgtctgacggtagatctcctctaccacaaacggcccacttaacacatctggatgataagtcagcggatacttcgccttgtactcctcaatctggcgtatccactcactgtgatcctgctgcgtaagcatctcgtttagtttcgaaagcacgactttaatatccccggtcacaccctgggtaatgatgacgtttttattcatctccgccggatcaatgtcgatctgcaaaatcttcgctttcgaggcgaatttcttcgcatttccagtaacacggtcactgaatctggctcctacaacaatcagaagatcacactcgctgactccatggttggacgtcttcgtcccgtgcattcccaacatccctgtgtaatacggatccgttcccgggaaggcgccttttcccatcagggaatccgcgaccggggcatccaccttcttcgcaaactcaagcaattcctcagccgcatcagagagaaccgcacctccgcctacgaagatatacggcttttttgcctcctgaatcatatctgcggcagcctgaagctccacttcgtccacacactctcttctccttggttggacgatcttctttggctcatattctgccatattggccgtcacgtccttcggaatatcaatgagcaccggtcctggccttccccttctcgcaatgccaaatgctctgcggatcgtatccgcaagctgatttacatcctttacaatatagttatgctttgtgatcggcatagtgatgccagcgatatcaatctcctggaaactatcttttccaaggagagagactcctacgttacaggtaatggccaccaccggaatggaatccatgtaggctgtggcaattccggtcaccaggtttgtggctcccggtccacttgtggcaaagcatacccccacttttcctgtcgctctggcatagccgtctgccgcatgggccgccccctgctcatgggaagtcaggatatggcggatttcattctggtgctgatacagtgcatcgtacacattgaggatagcgccgcccggatatccgaacactgtatctacaccctgctcttttaaacattctattacaatttctgctcccgtaagcttcattgtttttcatcctttcgtctagtttttcggaatttccaggattgctccccggtttccacttgtcaccatggaagcgtaccttgcaagataacctgtacgaacctcaggctctttcggctgccatgcctgtcttctcttctcaagctcttcccctgatacggcaagctccagatttaatcctggaatatcaatacggatgaggtctccttcctctacaagagcgattggcccgcctacagccgcttccggtgacacgtgtccgatggaagcgcctctggacgcgccggaaaaccttccgtctgtaatcagagccacgctggatcccagtcccatgcccgcaatcgctgacgtcggattgagcatttccggcataccaggccccccttttggtcctacataacggatcacgaccacgtcgcccggatgaatctcgcctcccttgatagccttgatcgcatcatcctcacagtcaaagactctggctggtccttcgtgaaccatcatctcttccacaaccgccgagcgttttaccacacttccatcgggagcaaggttccctttcagaacagcaagccctcccgtctcactatatggattgtcaatcggtcttatgacttctggattcttattgacgcatccggcaatattttcctttactgtttttccggtcacagttaggcagtctgtatgtaatagtcccttcttatccagctccttcatcacggcgtagactcctcccgcctcgttgagatcttcgatgtaagtcgggcctgccggagccaagtggcagagattcggcgtcttttcactgatgccgttagcaaaatcaatctcaaaatccataccgatctcgtgtgcgattgccgggagatgcagcatactgttggtggagcatccaagcgccatatccacagtaagggcattcaaaatcgcctcttttgtcataatgtcccgtggacagatattctttttccaaagctccatcactttcattcccgcatgttttgcgagacggatccgttcagaatatacagcaggaatcgtaccattgccctgtaatcccattccaagtacctcagtcagacagttcatgctgtttgcagtatacataccagaacaagagccgcaggttggacacaccttgcactcgaactcatccagttcttcctctgtaatagatcctgccgcatacgctcctacggcctcgaacatgctggaaaggcttcgcttttctcctttcacatgccccgcaagcatcggtccgccgctgacaaagatcgtcggaatgttaatcctggctgccgccatcagaagtcccggcacatttttatcacagttcggcaccatgacaagagcgtcaaactgatgtgccagcgccatagcctctgtggagtccgcaatcagatctcttgttacaagagaatacttcattccgatatgtcccatggcgattccgtcacagacagcaatcgcggggaatacaatcggtgttcctcctgccatagcgacgcccatttttaccgcctccacgatcttatccagattcatatgtcctggcacgatctcattgtaggagcttacaattcctacaagtggccgttccatctcttcctttgtaatcccaagcgcgttcattaaagaacggtgtggcgcctgctggcttccttttgtcactgtatcacttctcatgcttttcttcctcctcgttctctgtctgtcctgtctcttatatccgctcacagatgaggtctcccatctgtttcgtacctactaaagtgcagccctcagacagtatgtcgcctgtccggtatccatccaaaagcacttggctgactgccctctccaccgcgtctgcctcctgatccagatcaaaagagaagcgcagcatcatggcagcggaaagaatggtcgcgatcggattggcaattcccttccccgcaatatccggcgcagaaccaccgcttggttcgtacagtccaaacttactgtcatttaagcttgcgcttgccaacattccgatagagcccgttaccatacttgcctcgtccgacaaaatatccccaaacatattctctgtcaaaatcacatcgaactgctttggattcctcacaatctgcatcgcacaattgtcaaccaacatatgctccaacgtcacgtcaggataatcctttgccacctcctctgtcacctttctccaaagtctggaagagtcgagcacattcgccttatcgacactggtcactttcttagagcgcttctgcgcgatatcaaacgcacgctttgcaatccggcggatctcattctcattgtaggaaagagtgtccatcgccgtcatcacaccgccgatttcctctgtctttctctcaccgaaatacagccctcctgtcagttctctcataatcataaagtcgaatccaccctcggtaagctccggctttagcggacaggcatctttcaactcttcatagagtactgccggccgtagattagcaaaaagtccaagctctttgcgtatccttaaaagccctgcctccggacgtctggatggctccagcttataccacggagacgtctttgcgtcacctccgatggatcccatcagaaccgcgccgcactgctttgcctcctccacagtctcgtctgtcagcggaactccatggacatcaatggatgcaccacccaacaaaagttctgtatactcacaggtgtggccaaatctctctccaacaagatccagcactttcatagcctcacggacaatttccggtccgatgccatcgccttttatcactccgatttttaaattcattcgtatccctcccagaaaatctgttatcaattatcatataatattttcgtttttgtttcaaccctttaccttgtaaaagtgtttagctacatcttccaattcgccgcagtgcgcttcttgcaaagcgttttttatctcataggaacacagtttcctaaaaaataagaaaagcagaccccgcaaaaagcggaatctgctccttcattcttatgctgtctcattcctatttggcatctcctgcacctggcttttctacttgcataatggctgccttctgcatcgggatacgacagtttttattatttccgaattctacgatgacgtcctcttctgtgatgtcgattacaacaccgtaaaatccgcttgttgtcagaactgtatctccaacttccatatcagcgatcatcgccgctactctcttctgctctttcttctgcggtctcatcaggatgaaccaaagtccaccaagaactacaacataaaagagaatcaaaaagagcggattcgcaaataaacctccgcttgactctgtcagtactgtgtattccatcattctttcctcctacttctagctaaacactattgctatcatacacaatttttcccaattcttcaagtacttttccggattttatacattctttacttctggcttaggctcattccttccagcttctgctttttgtattctttgtaacgtccttcctcaatagcagcgcggatctcttccatcatcgtattgtaaaaatacagattgtggagtacgcagaatcgcataccaagcatttcttttgccttcagaaggtgtcggatataagctcgtgaatatttccggcaaaccggacagccgcacccttcctcaatcggacgctcatccagttcgtacttcgcgttgaaaagattaagcttgccgtgattcgtgtacacatgtccgtgtcgtccgtttcgtgtcggatacacacaatcaaagaaatccacgccccggtctacagcctccagaatattagcgggcgtccctacccccatcaggtaggtcggcttttccagtgggagatacggaacaaccgcatcaagaatccgatacatctcttcatgggattctcctacagctagaccgccgatagcgtagcctggaagatccagctcagcaatctcctgagcgtgggcgatccggacattttccaggattccgccctggttgattccaaagagcatctgatgtggattgatcgtatctggcaagctgttcagccgctccatctctgccttgcaccgtctgagccagcgggccgtgcgggcaacagagcgctcaatataatcccggtccttcgtgctggctggacattcgtcaaaggccattgcaatggtagacgccagatttgactgaatctgcatactttcctccggccccatgaaaatcttcctgccgtcaatatgggaatggaaatgaacgccctcctcctgaatcttgcggagtcccgccagggaaaacacctggaatccaccggaatctgtcagtatcggcttgtcccacaccataaacttgtgcaggccgccgagctttttgataacctcatctcccggtctgacgtggagatggtaggtattggaaagctccacctgcgtcttaatttcccttaaatcatccgtggaaaccgcacccttgatggccgctgccgtacccacattcataaacaccggcgtctcaactgtgccgtgtaccgttgtaaaacggcctctctttgcgaggccgtctctttttaataattcatacatctgtcttttctccgttctgtctttaaaatctaaaaagtaaccgttcagccatggcagcttgtattcgctgctacggggcttatatcatcacaaacgtggctgaacggttgccttaaaaatggcagatgatcggtgtcgtctcattgatcagatcatacagcttggctgcatcgtcatatttcatattgatacatccatgagacccgtgtgtcagataccagtctcctccaaatcgagtctgccatgaagcatcgtggaatccaatatcattattaaacggcatccagaatgccactggcgattcgtaggaatactttccgtttggaagaagctgtccacgaagcaccgcgtttttcgtcttataggtaagatcatagcttccctgcggagtatcatccgatccgtttggctttccggttacaatgtcgcagttcataatcatctgaccgttctggaagaaccagaatttctgtgtcgtcagatcaacttccgcataggtattaccatagtcattctgatctccatgatccgctcctcttcttgaccacttcggctctcttgacacttcctgcccactttctatatttgcagtcaaagccgcatattcatctttctggttcagataccatccgaaatccccgccttctacctgaaccgtgtctccacgacctgatacaaatgtccttgtcgtgccgaccgtattgtactttgtcgcaagttgtgcgatatatttattgattttctcagtattaaaagtcacctgcatcttgtcatctaccgtcagccactgcgaaatcatcgtcttatccaccacctcagtcttaggtgaaaagtcgtaggtgatcttcgtctggagatacttattcatcgtatctactgccgcctgtacttctggtgattcctttgtatacgctggtgcaagataacagccggacgcctccatgtcgagctcctttgtaaagccgctcaccgcttcctttacctttgcggcaaaggtctcctgattcacctgggtgccgacaacctcatcctggatgacaaactgattgccgtcatagaccggctgcgcattcttggatacaacctggtcaggcgccgtcacgcattgtaaagatgcaagcaggctgtcaagcttcccctcatcgtactcgataccgatctctgctgtaacgtcagactctttccaaaacgccttcggccagaggaatggattctgcttctccttgactttctcaagggcatggttcttcttgtaaatgacatcgatatcctgtccggaaatctcctccgtctgcccattcttctcttttaacgtcagagtatagctctccacctggttcttcatatgctcctctgcactcgcaacgctcttccatgagaaatcgctcccattgatcgtcgtgtgcggataaaaatgactgtgaaaataaaaggctccgcccagatatacagccgccacaactcccacaacacttcctaatgtgataaaaatccgtttcttcgtgttcttagacattgtttttttctcttttttctttcttggccctcttttatgcttaatccttgtctttcttaccgtcgtattgtcactgtccaatgtatgatcctgattcgaaaactgaagctcttcattctgtctgttttcgttgttttccataattctaatctaccccttgcttattaaccttatacatcgctattataatatgtctatatggaaaagtacagtgaaaatttgttgaaaattgtcggatgtattgcttacttttcgctgtctttccacaaaattcgattgcagttttccccctccttctatataatatataacagtttatgcaaaatttttcgtattgggaggtatgattatggcaggatcatcttttggaactctttttcagattacaacatggggcgaatcccacggagccggaattggcgtggtggtggacggatgtcctgctggactttctttgtcctcttctgatattcaggttttcctaaaccgcaggaaaccggggcagacctcctactccaccatgaggaaagaagcagacgaggtagaaatcctctccggcgtctttgagggacacacaaccggtgtcccgatctctatgctcgttcgcaatcaggatcagcgctcccatgattatacacagatcaaaagctgttaccgccccggacacgcagactacacctttgacgcaaagtatgggtgccgggactaccggggcggcggccgctcttccggccgggagacgatcggccgggtggctggaggagctatcgcttctttgcttttaaagagtcttggtattcatgtacaagcctacaccaaggcaatcggaccttacacgattccggaggaagagtacgatttttctgttcttacgaaggatccgctttgtatgcctcacctgggctattccgaaaaagcgcaggcatatctgaatacttgcatgaaacagaaagactctgcgggagggatcattgagtgtcagatcacggggcttcctgccggaatcggagaacctgtttttgacaagctggacgctctgcttgcccaggcagtgctctctgtcggggccgtcaaaggctttgaaattggagacgggtttgccgcggcaaaggcaaagggcacagaaaacaatgatgcgttctgcatccagaacggacaattagcgaaacagaccaaccactccggcggaacgctgggcggaatgagtgacgggagtactgtctgcttccgggcggccatcaagccgactccatcgatctcttctgtacagcacactgtcaacactttcatggaagaggtagaactctctgtaaaaggacgacatgatccgatcattgttccaagggctgtcgttgtcatagagtccatggccgctctgactgtagcagacctgcttctgcgcaacatgagcgccaccatggacaacctgcgccggatttaccagtagcttttgttctatattggttcaacattcctctgagactccaaaaaggaaaggagattcccctatgtcccgggaactgacttatctcatcacagaagaaaacatcggaacttccccgcttacaatccatggctttttaaaaggccgcggatattctcatgcggttcttgtctctctgaaaaaaacgccggaagggattttgaaaaatggcgtctgggccagagtccacgataccctctctccaggagatcgtcttttagttcgtctggcggaagaaaagacctccgaccatattgttccaagaccattgccttttccagtcatctatgaagatgaagatctgctcatcgtcaacaagcccgccaacatgccgattcacccttctcaggggaactacgagaatacccttgccaatgcagccgcctggtatttctgtcagaaaggcgaatcctttgtctaccgctgcatcaaccgtctggaccgggatacgaccggtcttctgattcttgccaaacatacttacagtgcggcgctgctctcccggatggtgacagtccgcaagattcaccgggaatacctggctgttacaaaaggtgttccggatgtttccggcatcgtggatgctccgatcggacgtaaggatggctcgaccatagagcggcagatagattttgtacacggagaaacggccagaacccattatgagcttctgacctctgaagatggatattccctcgtccggatctggcttgatacgggacgcacccaccaaatccgggtccacatgaaatatctaggctatccacttccgggcgattttctttactgcccggattacacaaagataagacggcaggcacttcactcctaccgtctctcctttttgcatcctatcagccaaaagccgctttcctttactgcttcacttccggatgatatgcgtgcctttttctctgcttccacattagaacagctctaaagatcaaagcatccccctccgatgaactcccgtaacagggagtttgccggaatccgatctgttccgattccaagaaaataatccaaaaacttcaaaaggcgttttgcctcatggtattcttccatatctggtgtaatctgaaagagaaggggctctacatactgcttaagcactgcaagctcataaatcagggccgaattaaacataatatccgcctcctcctggaacggaaagatgttgcgttcctctccccggcggacagaataccacatggcaattgtccttgccgctgtcgtacctctcgtccttgcatcacggacaatcctccggatcaatctcccatccgtcgtcggaatccggttgtgctcatctacattgagctgagtgagggcactgatataaatcttaaacttccggtcatccggaagggtttcggtaagcttcggattgagacaatggataccttcgatcacgagaatatcccgactctccatcttcagctttctgccgtcatatttcctctgtccggtaatgaaatcaaaagttggaatccccacctcttctcccagaagcagacgtcttaaatcctcattaaattgctctacatcgatggcctccaggcactcgaaatcatagttccccctttcatcttttggcgtttgatcccggttgacaaagtaattatccaccgcaagcggatgtggacgcatcccgttgaccttaagctgaatcgacaaccgatgtgagaaagtcgttttaccggaagatgatggaccagccaccagcacaaacttgacatcgccccgctttgcaatctgctctgcaatctccgcaatttttttctcctgctgcgcctcctgtacaagcaccatattctgcgctccagcctgcacaatttccctgtttaaatcccgcactgtctcaatattttgcagatccccccatctcatggattccttctgcacctggaaaagcttctctcttaccgcaaacggaggaatcacccttggattggcgatttccggcaactggatcacaaacccttcatcgtacagatggagggcaaagtatctcagatacccggtggatggtaccatgtaaccgtaattatagtcctcaaaagctcccatccggtacagattaacccgggaacttctccggtatttaaatagctcctccttgtcatacattccatattgatggaatagttctacggcctcatccgtatggatactacgcttttcgatcgggagatcctgctccacgatcctgtgcatggtctcctccacctgccgtagaaatacttcattcaggctgatatccccatcgatcgtgcagtaatagccctggcccgccgcataatggatcctcactttccgaatccggtcgtgtccggccgtgtcgtagacagcctttacgagcatcaggctcatgcttcttcgatatgtttttaatccgatatcatctcctgttgtgaggaaccggaggaaacaatccttttccagtgtcttatagagctccaggagctttccatctgagatcacgagcacaatatcattctcgtaatgcccctgaaaatccttcgcaatctcaagaaatcttgtcccttccggatactctcttgtggatccatcctccaatgtcacgcaataacatctcttactcaagttgccaccttctttccagccttataaaattacagaatacggcagttgttttggcattgtgaaaatctcgatctttcctcctgtctgcttctgcagatactgtttcatgtcctccataaacagatactccaatccgtagtgtcctgcatccaatactgccattccctgggcaaccgcatcaatcccggtatggtgcccgacatccccggaaaggaatacatctgctccttttgcaatggcctgatcaatcacactgctgcctgatccgggacagacggctacccgccgaatcttacgactgtttccaaaacagcgaagctcctccagtccaaaaatttctttgatacgttctccaaaggaaaaaagctcctccgattcttccaagataccaaatactccgattccgcacggcaattcctgccactccccggtttcttccaagggaacacattctttcaggccgatcttttctgccacaagtgctcccatcctgcaaacatcataattcgtatgcatcgcctcataggcaacgtccgcccgcaaaagctttccgatcctccttccgataaactcttcgtcagtgatccgcttcaccgcctgaaacaccaaaggatgatgggaaaggaccaaatccgcaccctgcaaaagtgcctggtctaccgtattgtcatcaacatcgaccgtgatgagaatcttctttacttccttatctgtcctgccgagaatcaggccgctgttatcccagcccatggcatatgcctcaggcgcggcctgttccagcaggcttcggatttcttttactttcatcttgtttctccttttaatgatatctggcggccgccctctccaggctctccttttcctctgtcagctccctgatacgagtttttcctcctcccccaaggtctgctcgctttgtcaggctatccagaatccgccccttttgctgtatctctctttttaagaactccaacagaaccggatggttttccctgagaaggatacgtccgtacttgtactcttcctccgtatagggcacttcttccttttttcccggcaccacccgcatcatcgggtaaaacttaccgtcctcgtataccatattctcttctacaatcgcacatgcatgagcaatgagaaacttacgcactttcccgatctccgattggggctgcaaaatacattcttttagagaaatcactatttcagggcagtccgatagtatctggataataagagcgccgcccattccggcggcgatcatgctctgtgcttcctgaactttcagctcttttagtccactggatcttcgggtctcgatcttatgttccagcccatgctctctaatatgtttttcagcccgtaaaagcggtccttcattaatatccatcgcaatcgcggacgggatccgcccctcttccaccagttgtatgggaacatacgcatgatctgtccccacatccgctatgattagtccgggcgaaacaagatccgccactgcccggagtctctttgatagttccatagcactctcctaatccaggtagtctcttaacttccggctgcggcttggatgtcgaagcttccgaagtgctttcgcctcgatctgacggatacgctctcttgtaacgtcgaattccttgccgacctcttccagcgttcttgcccgcccgtcattcattccaaaacgtagtctcagaactttctgctccctgtcagtcaaagtgtcaagcacctcatttagctgctcttttaagagggttgcagcagcagcctcagcaggaaccggcacattgtcgtcctggatgaagtctcctaaatgactatcctcctcctcgccaatcggcgtctccagagaaaccggctcctgggaaatcttcaggatctccctgacacggtctaccggcatatccagttcctttgcgatctcctccggaagcggctcccttccaagctcctgcaaaagctgcctggatacccggatgagcttgttgatcgtctctaccatatggaccgggatccggatcgtccttgcctgatccgcaatggctctggtgatagcctgacggatccaccaggtcgcataggtactgaacttaaatcctttctgataatcaaacttctctaccgccttgatcagccctaagtttccttcctggatcagatccaagaagagcatcccacgacctacataccgcttggcaatactgacaacaagacggagattggcctcggccagtctcttcttggcgctctcatcgccttcagacatccttctggcaagatcgatctcctcctctgcacttaaaagcggtacctttccgatctcttttaagtacatacgcaccggatcctcaatactgattccgtccggcacagacagatcgattttctccatatcgacttcttcctcttcttccgcaagaatcaggtcatctatatctgcgtccaggtcgtcatcacttccgatacgcagcacatcgatattcatcgcttccagatattcatatactttttccatctgctccggagataattccagatcggacagaaaatcgctgatctcctgaatttcgagaactttctttttcttcttcccaagttcgaccagctctttcagcttttcctcaaattttgctacgttttcttccatgcttttgtccatcctctcatcgcttgttctatctttttattttatggaaatctgcatctgatatagtttttgcagatcctttttcgcttccattagcttctgcagtcccctgatgtccgtcgggtccagcgtccgtcctgcctcttcaatactgtggttctttacccggatcaccgtctctttgagcgccttttcctgctcttccttcgtggaaagctcccgaatcttcgtatgaaacaaggacgctgcctccctatgctcctcctcatcggtaaaatgattcagaattctggcaggatttacacttccttcttcgtactgcttatagagaagctctgccacttcccggtaaatccgacctgtgaaatcctccggcgaaagataggtctttacttgggagaacacactgtgatcctcgatcatccaggtcagaagaatcttctgggatttcagattgccatcctccttctcctgaacagacgtagtctgcttcggtctcctggccggagccgctagtcccttctcaactgccgtctttgacacgagccttttcagatcctcaaatgatacccggtacgctcttgctaccgcctcagtataattatcccgctcgatctgctcttcaaactcgccaagccgtgacgcggcctcttttaaaaatgcggtcttcccttccggagagtttaagtcaaactgtctctctaatacttccaggctgtacatgaagccatttctggccttctggatccgctcctcaaatgccggggctcccagattcttgatgaactcgtcgggatccttatatggatccatccggatcaccttcgatgtaatccccgcctcctttaagatcggcatcgcacgaagtgcagcctttgttcccgcctcatcgctgtcataagtcaggtagacttcctgtacatagcgccggatcagcgaggcatgcccaggtgtaaatgcggtcccaagggacgccactgcattcgtaaatcccgcctgatgcaaagcgatcacatccatatagccctcgcacaagagaaaatacgatttcctggaagttcttgcccgattcagcccatagagattgcggctcttatcgaaaatcggcgtctccggggaattcaaatactttggctttgcatcccccatgacacgtccgccaaaccctatcacacgactattgacatccataatcgggaacatgacccggttccagaacttgtcatggattccctgtttctcatccacgcttgcaagccctgacttcacgatcagctcatccgagtatccctgcatctttaggtatctgctcaggtcatcactatacttattggcatatccgagcccaaaatgtacaatcgtctcttccgtaagcgaccggtccgtcagataacggatcgcctgtcttcccttctcagagcggagctgtgcataataatacttcgccgccagcttattaatagcaagaagcgtctcccttaaatctgatctttcctttgcctctttggaatactgctcttttggaagctctaccccggcccgttcagccaggatctgaagtgcctccgtaaacgaatcatgctcatattccatcaagaatgtaaacacattccctcctgccccgcatccaaagcagtaatacatctgcttgtcccggctgacagaaaaggacggggatttttcattatgaaacggacacagtccaaaataagaatttccttttttttgcagtctcacataagaagaaatcacgtccacaatgtcgtttttcattcttacttcttcgataatgtcttctgagtaatacacgctgttcccttccttcttgtctgtgtacattctcctacaatattatatattcgacaaaagatgttgatttcctttttgttttttttattttttcaaaaaaagcgaacaagcccggatttatttctctttttcctgtgcaatccgtttctgaatagcatctaccactgtctcaagaaccttgattcgtgcataatatttattatttccttctacaataatccatggcgctgacggcgtggatgtctttacaagcatctcttctactgcccgttcatagagatcccatttctcccggtttctccagtcctcatccgtaatcttccactgcttctcaggatttgcctgacgctctttaaaacgtctctcctgctcgtctttatcaatctgcatccagaatttcatcacgattgctccggaatccgaaagctgttcttccatttcgttcatttctttgtaggctcgtttccattcccgcttcgtacagaatccctcgatcctctctaccattactcttccgtaccaggtccggtcaaagatcgtgatatgtcctttctttggcatcttcacccagaatctccagagataatggtgcttcttttcccagtcgttcggagccgccgtggggatcacgacatatcctctcggatccagtgcctgggtcagccgcttaatggccccaccctttcctccggcgtcccatccctcaaatccaaggatcatcggaatccgtctgcggtacagctccccgtgcagcctcgtcaattccttttgcaactttttcttcttcttttcatactcttcttttgtgtaagccagagacagatccgccttgttcagaactgactccgtctttttctcgtctagctccggcgccgtttcatccggctccggctgttttttaaccgccgtttccagtgcgtggattactgtcttataaattttcaccgctgcatagcgcttgtccgtcgcttctacgatcgtccatggtgcaaagtccgtatctgtctttgccagcatctcttcattaactttcaggtaagcgtcatactcttcatttcgtctccagtcgtccccagttactctccattttgtctctttggaatccgccagcttttcaaaccgcttcctctgctcacgtttgtcgatgtataggaacagcttaatgatgaccatcctgtcatcggtcagttctttttcaaaagactgaatcacatgataggctcttgccacctcgtccgcagacatttgattttcgaaacgctctcctaagactttacggtaccagcttgtatcaaaaatagaaaccttcccatgctccgggattttagtccaaaaccgcttcatataaggatagtacttctcctcttccgtctctttcttcactgcgaacacttcaaagcctctcggatccagtgcctgaatcagctttccaatctgcacgcctttccccgaagcgtccagtccttcaaacacaatcatcaccggaattttggcgctctgacagattctttgcagttcaccgagcttcaccgaaagcttgttgatctcttctttatattctgctttcttcatcttttttgataaatcaattttttctaacattatccttcctcctcatagaaaaaattttttcatttttttgttgacattactctcctactatagtattatatttttcggacagccgataagaaaggctttgcggaagtgtcggaactggcagacgagcaagactaaggatcttgtgactattgcagtcgtgtgggttcaagtcccatcttccgcacggaagaaacccttgcttttatagtaagggttttttatttgttttggcaacaacgtaaaacgcaggcttaccaagggttctggcgaccgcttacaatctcagaatatgtcatccatcagttttggtgtttcttccatgaaatatacttttatttctgattttgccacattatctttttatgttcctttgttctccaccttcctcctctataatccggcaaataccgttttctttcctcccattcgcttctgaacatatggtaagaatatcatatcatgtgccagggcagatttcaatcagtctgataattaccatcctcatacatttttcggatgtgtacaaaactcaaaaaacaatattttacgatttctgcttgacattacccttctactatagtattatatttttcggacagccgataagaaaggctttgcggaagtgtcggaactggcagacgagcaagactaaggatcttgtgactattgcagtcgtgtgggttcaagtcccatcttccgcattttaaatagggtgttgcaaaattatctaaactgataaaattgcggcaccctattttttcccccacttcatttcaaccttattttttccctatctctgagcttttatatatgctgccgcatggatggctgctaccgctccgtctgccacagccgtggccgcctgccttacctgtttgacacagatgtccccagccgcatagacgcctgcaagattcgtctcctgcttttcatttgtgacaatatatccgtctttcgtctcaagttccgggtagtcttctgtattcggagtggatccggcatagataaaaatggcgcatcctggtgcttgaatcgtttccagcgcccctgtatgctcatctcgtatcacaatctgatccgcttcctcttttccattgattttgataaggcggctgtgaaggcgtacttccatattccctgtctgccttactttatttgtaaattccggaatcgcccccagggtgtcttcgaaatgaatgatagtaactttttttgcgatttttgccaggtaaagagcttccttgaccgcaccatccgctcctccgaccacaaagatgtccttgcccacataacgagcaccatctttcgccggattcatcccggttccccggccttgaaactcctcttcaccctcaattcccagccttcttggccttgttcctgccgcaataatcactgctttcgcttcatagctgccctgatccgtctcgatgatcttaacctgacctgtaagctttgctttcttcacctgttccatcacaatctctacacctgccccctcagcctgtgctttcaatctagctgcaaaggtctctcctgtctcctcctcgatgatccctgcgtaatgcgtgacggtagacacgcccccaagcagtcctcctactgccttttgctccagaacaatcgtctttaaccctctgcttacagcatagatagcgctgctgattcctgccggacctgccccgatgatacaaatatcatacatccttcttcctcctctttctttttctatagtcagcttttctgtagtcagaatagcacaatttacccataaagaaaaatgatatattcttatcattccataaatttcctttattattcagccatgtgatcagaagacactcgtttactcatacatcgtggtatattttcatactgctcttttccctgcttcagaggatatatcttcatatctcaggaatcctatgtttgtaaaacaggaaagaaaaaacagaggccatgcccctgttttccatatcttctatataattaagcctggtttccctttgcaagctctgcaagtgccgtgaagcctgccacatcgttgattgccatatcagcaaggatctttctgttgatctcaacacctgcaacctttaagccgtgcatcagtttgctgtaggataatccattcattcttgccgctgcattgatacgtgcgatccagagctgacgcatctgacgtttcttctgcttacgtcctgcataggaacttgcgagcgctctcatcacagactgttttgccactctgtactgtttggaacgtgctcctctgtaaccctttgccagctttaatactctattatgtttcttctttgcgttcattccgcctttaattcttgccatgtcttactcctccttctattcttccaactcttataagtatggtaatactttcttcatgttctttacatttgtagaatcagtaatgatagcctttctaagatttctttttctcttagtagacttcttcgttaagatatggctcttgtaagctttatttctctttaattgtcctgttgctgtttttttaaagcgctttgcagccgctctatttgttttaatttttggcataatgataatcctccttaatattgtaaaatttatttttaacgtctttcagttaaaaccatgctcatgcttctgccttccatcttggccggcttttctactaccgcaatgtccttgagatgctctgcaaaatcatccagaatatgtttactttgctgaacgtgggccatctcacgtccacggaaacgaagcgtcaccttcactttgtttcctttctggataaacttctttgcgttgtttactttcgtgttcaagtcattcgtatcaatatttggagataatcgaacttcctttacatctacagtcttctgctttttctttgcctctttttctttccttgtctgctcatatttgtatttaccgtaatcgataatcttgcataccggcggctttgctgtaggagcaatcttcacgagatcaagctcggcttccagcgcaatcttctgcgcttctcttgcagacataattcctaattgttctccatcctgtccgatcagccgcacttctctgtcgcggatctgttcgttaatcattaaatcgctaattgtagtacacctccatgttttaatactcattccttgccataaaaaaatggatagtacagactatccacatgatctctctttacaaatcctctcctctaatgtaaaaatacataagattcggctgtaattcaatatcaaaccatcagtcactcaatcgtgctgcggtgagagtggatactctgctttcttttcacacaagttgtatattagcatatttgtcacagactgtcaatggattttttacctttttccacctttttattttcttacattgattctgctcctactagtataaattctggaaagccggaaagacttttctatatcaaatatcagatcacgggaggaaaaatatgaaggtttccagaatcgtacaggaaaatattgcttacatgaacgagctgctccccgtacaggaaagctatgacattgtagagagagacattgtcatcggaggacgggaaagctgcttcttttttatagatggatttatgaaagacgaggtaatgtctaagctgatggacacatttttcaagattaccgaggatcagatgcccgacacggccacagaattttccagatcctttgtctcttatgtggagattgatacattttccgaatatgacaaagtcattaaaaatctgctctccggtgcagcctgcctttttgtagaagggtacgatgcctgcattatcattgacagccggacgtatccggcccgaaacgtcggagagccggagcaggacaagtcgctgcgtggatccagagatgggtttgtggagaccatcgttttcaacactgccctcatccggcgtaggatccgggatccgcacctgactatgaaaatgatggaaatcgggaaatcttcccggacagacgtggtgctctgttatatgtccgaccgcgtaaacacggatcttttggctcttctaacccgtaagattgaggagatgcaggacgaggatctgaagatgaaccagcaaagtctggccgaacttttatttaagcggaaatggtacaatcctttccccaaattcaaatacacggagcgcccggacacagccacagcctgtttgttggaaggaaaaatcgtgctgatggtagacacctcaccttcagccatgattcttcccacctccatctttgacatgatcgaggaggcaaatgactactatttcccgactctgaccgggatctacctaaagctctccagaagccttattactattatgaccattttcctcacgcctctgtttctgctctttatgcagaatccgaaatggattcccgatattttcgaattcgttcttgtgagagatacggtcaatattcccttgtattttcagcttcttcttctggagcttgccatcgacggtctccggcttgccgccttaaacactccaagtatgctcagtactcctttaagtgtgatcgccggtattgtcatgggagaattttccgtcaaatccggttggtttaattccgaggtcatgctctacatggcgttcgtggctgtggcaaactatactcagccaaactttgagctgggctatgcactgaaattcatgcgtctgctgcttcttaccctcactgccctctttgactgggttggttttgcggcaggttgcatcattaccgtctgctccatctgttttaaccgcacggtttccggagaaagctatctgaaaatcagcaaaaattaatataaaaattcattctctcttccagtataaatcttttgcgtcctgccataaaaaatggtatgataagaaaaaacagggcgaggaggttacagcaatgagagactttgtcattactacggacagtaccgtggatcttccgaaagaatggctggaagaacacagggttccgacgcttagattagcatatacgattgacggtgagacctatccggatatggagggtctgtcaaagaaagaatttttcgaccggatccgaaacggatctctgccgacgacttcccaggttactcctggacaggcaagagaactatttgaatctattattaaagaagggaaagacatcatccacatcgggttttcttctggactgagcggaagctgcggaagcgaacagatcgccgcacagcagctttcggaagaatacccggacgcacggatcaccgttatcgattctctctgtgcttgtctgggcgagggacttcttctctactatgtcttaaagcttcagaaagagggaaagagctacgacgagatcgtaacatgggcggagaagaataaacttcatgtttgccacaatgtcacggttgacgacttgaaccacctgcaccgtggcggtcggatttccaaagccactgcgatcctcggcacaatggtaaagatcaagccgatgatccacgtggacaatgaaggaaagctcagtgtcattggaaaagagcgtggacgaaaaaaatccctcaacaggatcgtggatgtcatggaagaacagatgaaaggctgggacaatgagattgtcatgattactcacggggactgcgaggaggatgcacagtatgtcgccggactcatccgtgaaaaatacgggattgacaacattctgattaacgatatcggaactgtcatcggaactcataccggtccgggcgtgatagccactttctgtatgggaaatcacagataagaactaattgcgggcagatccccgatgggatacgctgcccgcttttttgtactggcaacggtccaaagtccgggcttgcccgagaccttggcgaccgtttacaatcccggaatgtgccttctggcacttccggtgattcatttctcttctactgataaatcggatatctgccgcagatctccgtcacacttcttcgtatctcatctgcccgattctcaaaatcttctgccgcaagccggatcaatcttgcaatttccttcatctccgtttcccttaatccccgtgtcgttaccgccggcgttccgattcgaataccgcttgtaattcccggtttttgtggatcgttcggaattccgtttttattcactgtgatatagacttcatccagccggctctgcatctcttttccggtaatgttctgtttccttaaatccaccagaatcagatgattgtccgttccgccgcttaccagatcaaagccctctgcaagcatagcatctgcaagcgctttggaattctttacgatctgctcctgatacgttctgaattccggcttcaatgcctccccgaaacaaactgctttcgcagcaatcacatgctccagcggtcctccctgggtacccggaaagactgccttgtcaatctgctttgcgtacatttctttacagagaatcaaaccgccccttggtccacgcagggtcttatgggtggtggttgataccacatccgcatatggcaccggactctgatggagccctgcggctaccagtcccgcaatatgagccatatctacaaacaaataagcgccgacctccttcgcaatatcggcaaacagatcaaaacggatctcacgcggataagcggaagcccctgccacgatcagtttcggcttacattccctcgcaatcgcccggatctcgtcataatcaagaaatccattctcattgacattatatggtacaaaatgatatagttttccggactgattgaccggcgaaccatgggtaaggtgtcctccatgattgagattcatacccatcacaacatccccaggctgaattaacgcctggtaaaccgccatattcgcctgggctcccgagtgcggctgtacacaagcgtgctctgcgccgaacaactttttcgcccgctcgatagcaagtatttccagctcgtccacatattcgcatccgccataatagcgtctgccaggatatccttccgcatacttgttagtcggcacagtccccatagcaagcatcactgccggacttacaatattctccgacgcgatcagctccagattccttctctggcgtgccagttccagttccagtcctttccccacttccggatcatatccactgatataatccatgacttcctgtaccagattcattacacatcctcctttttcttatatcgtagtacttccaaaacctccgtttctgatgcctttcgcatcatcatcgagggtaatgccatattctacaaaaatcccctgcataaagccctctcccgctttcaaactgatcgtcttcccttcatttgtatcatttgtcaatttagcaaaaatatgtccttcgttgtccgagtaataataatcgctgtcaatgatccccacggtattattgagctgaagccggtacttaaatccaagaccacttctcggataacacttgagcacccactcctcttccatccagacacggatcccggtcgggatcttcactgtctctcctggtgcgatggtgatcggatatggagtgaaaaagtcataccctgcagagcctttggtcgcgcgctttggcagcatcaactcttcatacgccttttcagcatcccgacttatcaaaatcccttctgtcccttccaggaactgctctttacttactttctgaaatcttgcgattctcttcatcatcgttctccttcttctgcctttttctacaagtttttcattaatttcatcatactattccgtccgaggaaagtcaaatgatattccatagaaaaaggaagcgcacactcacgcttccctttttcataaaacatattccattaatttccacactcaatactgatttcattgaaaagattcagaatcatttccacggtcgtctcttccttttccttacctgcccggtcaagaatacatttcccctgatgcatcatcaacatccggttgccgtactcgaccgcatagcgcagattgtgtgtcaccataatagtggtgagcctcttttcctttacaatacggtccgtcagccccataatgatctcggctgtcttcggatccagagccgccgtatgttcatcgagaatcaggaaatcgatcggcgtcatggtggacatcaaaagcgctatagcctgccgctgtccgccggacaaagtgccgacttttacatccatcttatcttccaatccaagatttaactgacgcagcaactcgcgataatgctcctttcttcctttatgaatcccacggccaagtccatagaatttccctttgttgtccgccagggacatattttccaggatcgtcatggatgggcaggtgccaagggcagtattctgatacacccgtccgatcctgcggtttctcatatattccttcattctggtgatatcttccccatccatcaaaatcctgcccgaatccaccgggatactcccacagagaatattcagcatggacgttttgccggatccattgctgcctacgacagagacgaactcgcctttccggacggtcaggttgaaatcctgaaacaggcacatctcatttaccgtgcccggattataatattttgtaattcctcttaattcaagcatttccctttaccttcttctttctttccattccaacaatcagtatgaccaggaacaataccgccgtaatcagcttcatgtcctgtggctcaaagaatttcaatgctgccgcaacgcaggctttataaataatggcaccgatcagaaccgccgttgtcgctttcataaaggtcagtcccttaaacagactcgttccgatgatgacacttgcaagcccgatgacaatcgctcctgtaccactggagatctcaaagactctctgttcctggcagaagatacatcctgccagtgctaccagcccatttgcaatggcaagaccgagaatctttatattcccctgatcttttgcaagagacgtcaccagatgttcattgtctcctactgcccggagaagaaagccggacttggtcttcagatacagatctaaaactatcttggcaatcactgcgatcacaaggacgatcacacagactttgtaggaggctagtgttccatgaaagatcccgttcatattgtcattgtcaaaaatactctcctccccaaagatcggaacattcgctgtcccggcaatccggagattgatcgtccaaagtgctgtcatcataataatcccggaaagcagatcccttaccttgcatttcacatggatcagccccgtgcagacccctgcaagcacacctgccccaaaggaaatcaaaagtgtcaggtatggattgactcccctgacaatcagagccgccgtcacagccgctcccagcggaaagctgccatccaccgtcaaatccggaaaatccagaatcttgtatgtgatatacactcccagcgccaggattccgtaaatcaatccctgctctactgttgttactataaggttcatttgtctgcctcccgttattcctttatgatgcggaaatctcatcaaagctttctacagcctgacttaccagtgattcatcaatggtgattccaagattctccgccgcttttgtattcacatagagccccggctctgagatggtctcgtattttatctcagaagctttcttctcgccctttaatacctgtgctgccatctttcctgtctgcttaccaagtttaatatagtctagaccctccgctgccagacatccaagcttcacctgctcaatctcgcttccgaataccggaatcttctgcgcgtttgccttgtcaaggatcgttgccaaagaattgactacggtattgtccgtcaggtttgtcagacagtctacctcgcctaacaactcttctgcagcaagagagatatctgctgtctgcgtcacacctttttctacgatttccagatcgtaatcacctgcaagcttcttgtatgttgaaagcgcagatacggaatttgcctcgctcgtcgtgtagaggatgccgaccttctttgcgtccggaagaatttcacggatcatctccaactgctccttgatcggaagctcatcactcgttcctgtgatttctcctaccgggttcccctcatcgtccacaagcttcgcctccgccggatctgttacagccgtgtagatcaccggaatatcagaattcattgctgagttaaaagctgcctgggcgcttggcgtcgcaatcccgcagatcagatctaccttgtcagatacgaacgtatcactgatttgcttggctgttccctgatccgccgccgcgtttttgtactcgattttgagattttccccttcctcgataccttcctctttcagcccttctataaagccttctctacagttatcaagggagccgtgctctgcaaactgtgagatcccaatcgtatactcagcatctcctgatttactgccgctgcttttgcagcccgtaagaagtcccattgtcatcattgcgcttaccaatactgctaccatttttttgttcatgttttttctccttttctactaaaatatcgttacgccggaagttatatgccaaacatccggctctgtcagtaagaaaggaagcggcgtcccgacagataataaaaaggttcctggcaaccccgaactttggcctatcaggatacaaaaaatccgccccaagctactgcttgagacggtaataaactcttattatcgcggtaccactcaaattggcatctctgcccactttctcatgtactaacatacactcctgattgataacgggttcggttcccgacaaaccgtactcaccattcggctttcaggctgccctcgaaagtccattcaaccgtccgctccatacagcagttccaccatctgccgctctctgtgatctcgcctgacgatctactcctctttctcatcggtttgaaatataaatcttgcgtatactttatcacactgctttactgctgtcaagtaattttttaatctcaattgcaatctcatctgcgcttttctgatccgtcactacttccagatctgctgcttcccgataatatggctctcgctccttcaaaagttctccgatatgttccggcgttttattctgttccagaagtggtctgtcatggttatccttcactcgctcatagattgtctccgggctagccgtcaaaagtacaacgataccgcacgctctcattgttttcacattttctctgcgcagaggcacacccccgccacaggatacaatggctccctctctctttttcagtccctccaggaaactggtctcacactgcctaaaccaggtttctcctttctgtacaaagatctccgggatcgacattctttccattcgttcaatctcccgatccatatcgatcacatcgcatgaaagtatttcccgcaatgctttggaaatcgtagtctttcctgtccccataaatccggttaaaaaaatatgcttcattctatccctgccttccctgatcgattgacattccttttttcattctttataatcttagcataatcaaaaccagatagaaagagggaatcccaatgtcattacaaatcagcgggcacaccgggctgcttggcttcttcgcagatcctgccgcccactccaaatcacctttcatgtacaatactgcctttcaaaagcttggaatggactatgtctatcttgcctttcagatcgatcagacatctcttgcagatgcgatccgttccatgcgtaccttgcaaatgcgtggagccaacgtctccatgccgaacaagacggctgtcatacaatacctggacgacatttccacagaagccagactgtgtaatgcagtcaatacgattgtcaatgaaaatggccgtctgatcgggtacaataccgacggaaccggagcaatgctcgctctctcccatgcaggcgtctccatccagggaaagcatcttatcatcctgggcgccggaggcgccggcactgctattatcactcaggctgctctggatggagcgtcgaaaatttccgtgtttgtacgaaaacaaagtttctggaaatctgaagatttcctggaaaagatccgtaagaaaacagggtgccggattgcacttctgaatttggaagatccggatcttttaaaggccgaacttgtccacgcagatatcctcatcaatgcgaccagtattggaatggaaccaaatccggactcctgtgcggtgtccggtccgaaagatttgggtgaccatctgtttgttatggatatcatctattcccctgaggagacaacgcttcttcggtatgccaaaacagccggcctgagctgctgtaacggtctcggtatgctcttatatcaaggagccgctgcctttcgtctctataccggagaagagctcccggtagaggacgtcagaagagcatggggcatctctacactataaaactgaggctgctaatacaaaagccggaaagcatggtactatcaacactcatgatttgcaattgcggaattagaaaaagacttgcatggtttctgaccttacaagtcctccgccgcatcatagtaccactgacggccctcttccgttaataattcccccgcggtatatgagctttgccttgttccttgccccactaagggcttgcaaaccggaattttactatagtgttttactatacaaaaaatatgttaatggaactttccctttcgacatgtccagtacaatctgtttttcctctcttatgtaactatctatttatcatttgccatacaaactagaagttgttactttaatacgaaatatgaatcatattccatcccatcatgtcctattagtttctcctccgactgtttaaagcctaacgcttttaatgctgaaatccgttctgttgctaatgcgatagcttttgtagcaattttatcacaatgaaaaagtgcatatgcaggttcgattatcaattttagtattttgacaatctcactggcaatttcataatcactccgaatatccaatctaagcaagccacaatttgtaaaataatcttcagcgtctctatggaaaagctctatcgtgccgattgcttcttttgttgcttttgaaacaatcgcccaacggacaaacccttgtctatcatattcccaaagccaatattcaatcgcctgtgccattcggttttcagttgtatagtgaaagttatctccgccacaattatcactattaaaaaatgatacagctttttcatcagaatatacctttaacaaatccaatttatccgccttatctaccattctcaatatataatattcattttcaaaactaggacaatttttatatacatcaaccaccatgctaatttccctccaaaaattccgaatcgatgtcgctattttaaaaatttcatcacttcttccatagaactttttcctaatgtaaattgttctagtgttatgtatcttttctcagccatagtatattctctttcatacaattcctttaccatgttctcttcattatctaaaggctcgacaatacttgatttggtctgataagctttaaaatatctaatgccaaaccttctttgagactctgcattgatatggataccatctggattagggtataatttttcccctgttacaaaataacaattcctattattttctacatatttaagtaattcctgattaatcaaatcatactctacacaacttcttccaaagccagacttacctaaataatttcccaaaccgccaacaataaacggaacttccaaatctcccagctcttttctgaatgaattaactaaaatattaagtttgtggtaataatttttgtattttttgcttcgaccatcgctttctccttgatgccacaaaattgcaatcaattcactgttttccatagcgaattttgcttcactgacggcatggcgaaatagagtgctttccttactccattcatcaatagaacttcctccttccgcacaagggataagcccaatttgttcatttttatttgcgttacaccatgcctgtgcaaatgacgctgcaggaccaacgccagccactgagcggtcaaagtggattggctcagtcatcatctgccatctgccgttcctaagcataaaaatattttcattgtaaattggcgtaacctcatgcaaatatccacgtcctgccatatttgattgccctataagtaaaactgatttcatttttctcctatcgtttagttgttaaactctttctgtattctgcctctttgtcctgtagacaagaagtattcctcgttttcaacccggtcaattccaatttgctaatgaaagtcagcctctaatacttctactcgaaaaagtagctatcttgaaaacgttctttatcaaaattccattcagactacatatttgaactcccataacaggagttcccttactcccattgtactcccaaacttacgatgttacccggtgttttcaacattttataataagtccgaattacaaaattaccgagaaacccgcattaaaatggtgttcctaccaaatcatacggtgtgatctgatatacgtagtaattcagccagtttgtatacagattgttggcattggaccgccaagtaagaagcggccggttttctggattatcatccgggtaatagttacaaggaatctcgatcggaagccctttggatttgtcccgtttgtactcttcatccagcgtcatgcgatcgtactcaggatgtcccataacaaagatctgcctgccgtcctttgtcatagccagaaagacgcccgcctcgtctgattctgccagaaccatgagatcttcacacgctttgatcttcgcaggatcaatctgggtatgccgggaatgcggtgcatagaatacatcgtcaaatccgcgtaccagtggaatcctccgattcatcacccggtgccgaaagacgccaaacagctttttcttcagcggatatttgtcgatcccaaagtgataatagtaggctgcctgtgctccccagcaaagataaatcgtagaagtaacgtgggtcttggtccactccataatttccttcatctcttcccagtagtcaacttcctcgaatggaatctgttcgatgggtgccccagtaatgatgaaaccatcaaaattctggtctttcacgtcctggaaccgaacataaaatttatttagatgattcgcggatgtattctttgactggtgattggacaccatcacgaaagtcacatccacctgaagcggcgtattggaaaacgagcgcaaaagctgaagctctgtatcctctttcagcggcatcagatttaaaagcccaattttcagcggacggatgtcttgatggacagcacggtgttcatccatcacaaagatattttctctctccagaatctcctttgccggaagatcattttgtactcgaatcggcatcttctgttctctcctttatatcgtcttttacatattggaatgttccattgtcatccagatattctacccttccataagcttccgtgtctgcaggcatctttttcttctccaatttctgctctaccaccattttcacgatatagtaaatcacggcaaacgtcggtactcccgcaatcatgccgacaaacccaaagagtccgccgccaagcagaatcgaaaatacgacccagaatgcggaaagccctgtagaatccccgagaattttcggtccaatcacattcccatctaactgctgaagtgcaagaataaaaatcagaaaataaatccccttgatcggatcagccagtgcgatcagaatcgcactggggatcgctccgatatacggtccgaaaaacggaatgacattcgttaccccgacaataacgctcaccagtaggatatatggcatatccagaagtgtcagtcccaggaaacacagtactccgataattgcggaatcaatgatctttccgatgataaaccctccaaaaatttcattactctttctcgtaatatgtaaagtcatattggcgtgctcaatggacatcactccatagagaatcttcttcatctgcgccgcaaacagctctttactgaaaagcatgtacacagaaacaatgcagcccacgagaaaattgaatacctcgctcagtacattcatagcccccgtagtaatattggtcatccagatattcatctgccgcaacagatccgtctgaatccagttctgaagcgtctcagaagcatgattcagaatattgcccagaagcaatcccatagtagactgttctttttgcaaattctcaatagcctcaataccactgttcaactgtcccggcaatgtttccatgaggttccggatgctgtgaaaaagctccggtatgagcatatttagcagggcaaaaatcacagcaaacagaaccagcagggcaaacaggatcccggccgccctggaaaattgccgtgccgtcttttcttttttgatttttttccttaaaacaggcaacagatacttgtctgtctcttttacaattggatttaaaagatatgcgatagcaaaaccataaataatcggttttaagatctcaatgatcgttcctgctaccgaaaagagagtatctgctctcagaaatgcaaaatacaggataatacaggctgcgatcacaagaaaaatagtcagtcccctcccaaaagactgccgaatcctggacggcccttttccaccaaaggcaggtatcttccggacttctttgtcttttttcccgacttcatttttggtattggtttctttcatttccatcctcccggtctccatacacatatacttcattatagcgaaacctcgggaaagcgtcaatcactggaaatggccaaatggaacattccgagattgcagctgtgacaaacctggattttagctcctctccggagcaacaaaagaacaggcggaaaatccgcctgtcccaatttttgcgtcttaacggcactggaaagtagcacactcagtgtctttgcaggtacatgccccgccgccttccacactgatttttccggcattacatttgcagttttcgttataacagcattcctgagctttacagtcgatcgtactcaacggagaagcctccatagacgcatttgtaaacgtcccggattttctctcctcaaagctgtcgcaacatgtgtcggcagcattctttgccttgtccccaccaacctgaatagcatcgaggttacagtaatagttctgattgtgcatacaattctgtacagtacatcttaattctggcatcttttcatcctccttctagttttcagaaggtagtatgcccgaatttcaagactttattctttagactccatgcttcttcttatttttccagaaatttcctttttcaaatcacagagaaagtctttcagacatttttgcccttcatctcccgcaaatctgcttctgacggaaactttgccttcctcttcttctttcgctcccactacaagcatatatgggatcttctgcatctgcgcctcgcggatcttgtatccgatcttctctgctcttgtatcaatctccacacgaattccggcgtcttttaaagcggcatagactttctcaccatactccagatgcttgtcggagatcggcaggacttttacctgaaccggtgcaagccaggtcgggaatgctcccgcaaaatgttcaatcagaattccgatgaaacgctcaatagaaccgaatgccacacggtgtatcataatcgggcggtgcttctctccgtctgctcctgtatattccaggttaaagcgcagcggaagctggaagtcgagctggatggttccgcactgccaggtccgtccgatggagtcctccagatgaaagtcgattttcggtccgtaaaatgctccgtctccttcattgactacatagtccatgccaagggaatccagagcgtctctgagggcatctgttgccagttcccagtcctcatcgcttcccatgctgtcttccggtcttgtggagagctctacatggtacttgaatccgaacatcttgtatacttcatcaatcagagtcgcaacccctttgatctcgtcttttacctgctccggcgtcataaagatgtgggcgtcatcttgtgtaaagcaacgcacccgcatcaggccgtgcatctggccggatttctcatgacggtgtacgataccaagctcgcccatacgaatcggaagatccctgtaggaacgcggctcagactcatataccaggattcctcccggacagttcatcggcttcacagcaaaatcctgctcgtcaataacagttgtgtacatattctccttataatgatcccagtgtccacttgtctcccacaaatgtctgctcaacataatcggagtagaaatttccacgtatccgttctttgtatgaatttcacgccagtactccagaagagcgtttttgagcgccatacctttaggcaggaagaacgggaatcccggtccttcttctctgagcatgaaaagtcccagttcttttccaagttttctatggtcacgcttttttgcttcttccagcctctccagatattcatccagatcggctttttttgtgaaagaagttccgtagattcttgtcagcatcttgttcttttcatttccgcgccagtaagcgcccgcaaggcttgtcagcttaaacgctttgaccgtctttgtattcatcagatgcggtcccgcgcacaggtccgtgaattcaccctgcttatagaagctgataattgcgtcttccggaagatcttcaataagttctaccttatatggctcttctttctccttcatcagagcaatcgcttcctctcttggaagcgtaaagctctcaaccggaagcgcttctttcatgatcttcttcatttctttttcaatcttttccagatcttctgttgtaaatggaatatctctgtccacatcatagtaaaagccgtccgcaatggctggcccaatagcaagcttcgtctccggatagaggcgctttactgcctgtgccaaaatatgcgaggatgtatgacggaaggtatctttccctccttcgtcctgaaatgtcagaatattcagctcacagtcctcggacactaccgttctgagatccactacttccccgtttacttctcctgccattgccactctggcaagtccttcgctgatgtcagatgcaatctcatacactgacatacttttgtcgtactctcttacagagccgtcttttaatgtgattttcatcttgttcttcccctttctttcctaacatactttcacccgatcccgatccggatgttctcccgaccatcctgcaggaggcatggtatctagttcagacatctctaacccggtcagttcaaagtcaaagatgtcctggttatttttcattctttcctcggaagaggcttttggaatcgggacgatgcccttttgcagcgcataccgaagacagatctgtgccggcgtaacatggtgcgcttttgcaagctcttccaccagctcatcatccatcacacgctttcttccaagcggactccacgcctggacgagaatccctctctcttgacagtagcagacggcggcctcctgactgtatccgggatgaaactccagttgatccaccgcaggcacgacctcgcaggaggaaagcaggttctccatgtgatgcggaaggaaattactcactccgattgcacgaaccctcttttcccggtaaagcttctccatggctttccatgtttccacatccaactgcttccactccttcgtatccggcgaaggcttcggccaatggatcagatacagatccagataatccgtacccagattttcaagtgtccgctcaaaagcccggagcgtaccatcatagcccatctcatctttccataccttagagacaaggaaaaattcctccctcctgatcccactttcagcaactgcctctcccacataagtttctgtctcatagaaggatgccgtgtccagataccggtatccgcagcggatcgccgtcttgatgatctcagacgtacttccttccgccgccttatacgttccaaatcccaggcaagggatttgcactccattgttcaatctccatgtttctttcatacttttcatttgaaccatcctcctttcagactttccgcactttcttttgtccggcactgtcacttttccggaaacaaatcaccgtaagagccaaagagctcatgttgggattgtaatcgttcaataggtttccccgcaaacccgggctttgctcgtcgccgccaatcaaaaaaagcccctgcagctttccggctgcaggggacgagctttcacccgcggttccaccccgcttatgtcctctccattataaacaaggagaaaacatctcttgctaataatgataacggtattaaaccggacggtttttccgccgctcagaggtagtcttcagatgctccgtgataagaggcttccagccacggcctctctctctgaatccggtctcacaccctactcgtctcgtcaacacgtttcctactcaaatatagagtcattataatcacttcgttattatttgtcaatgcctgattatgtatcttttaagcggaagcatcaaaactgccagcgcttccctcactacataattgaaatacaacaccggctctgatccggcaggtacagaaaaaagtcttttgtagcccacttgcttcccgagcagacacgctcggtaaatgtgaaagctgttcgtcaccactcccacgcgccttgtgactaatcctgggagcatttgtgctgtgaagcgcagattttcctctgtcgtagaggactgatcctccaaaaaaatccgctctcgtttcatcccccttgagaccagataatccgccatggctttcgcctccgggatgtcctcaccccttccctggcctccggatactacaattctgacgctaggatttgcggttgcataagtatatgcccggtcaagacggagctttagggaactcgtaatccgggtgccatcgacttttgccccaaggacgatgagatactccagatttcctgccgcctgtcggtgtccgaatactgccatgcgaatccagacggccagaatgactacccagaacagaatccaggcgaaagacagtgcctgaatcatcaccgtcgggaaccatcctcccgctataccgtaacagacggaaaccagtccgcaacagatccagaatctggaaaaggtggaattccatcttcctacataccggcagatcatcaggtaatataacaggcataccgccgctgtcacaaaaggcattatttattcttaccgcagcagtgtttgtacttcttgccactgccgcacggacatggatcgtttcttccgatcttctttccctctcttacgaaagtatgcatctttttcgcttctttatacagttccttctgccgttcctcagaaagaagaatgttccactgcggaagctggtagagccagtctgccttcgcgtctaccatgttcttgtaaagtttctctttatcatagatcagagtgacttcggtatcctcctccatcgtctcaatcggattctcattgataaggctctcgttgattccgtcaagaaatcctaccatcgtcagcacttccacgccatatttctccgccagttctttgactgtacctttcaccttctcatccgggttggaaagtaatttctcataaatccccttttccgtctgaaaataagcgccccagaatgattcaagctgctgctttgtcatctctctggaatacgccgtctctctccactgctctaataatgtactcatatcaaattctcctttgattacaaattgtcttcacagagttcattatataacaggatattttatattgcaagggaaaccacctgcctaccattcgccgtatcatgtctcctgtgttctgcattgctttattctcccacattctatataattatcatagaagaatccatgaggaggtttttactatgaaacaaatacggcaaattctggccattcttgggattgttgttctggttgccatgtacacaagtacccttgtgtttgcgtttcttgaccactccgcttccctgggacttttgaaagcgtccatcgcctgtacgatctttgtgccggtactgctttatggttttacattattttcccgtctgttgcggcacgatgataaggacagcgatcatccgggcggcccatccgactgatccatccttggcggactttgactcatcgccaatacaaagcaaaacagtgcatcctacggggagttcccgtggatgcactgtctgtctctttgcgcggacttttgtctcacacaatagacttatctattttatttcatgccagactaaagaaaaggatcggatcagtgtccgccccgctctctttgtcctgatggcttttttctttttcctttttctcttttcttttgtttaggtactcttccatcgatattgcttccatacaccccggtatactcctttgctgcataaaataacctcctttttctgtttcccggtatcactattatatgaaacgaaaaactgctttatgactccccctttacggttttcactttatcatgtaaatatgtctgatgtatggcggtgttctaaaatttttctaatcactttcttaaaattccatccgcctgctcttttctccatggcaaccatacttctgtctgtcattgctttatgtacttctcttcaacggcactttaactcttgacaatacgaaagtttttatgtaaactagaaataatttttttaaaggaggactcaaacatggaacatttaacgataccagaaggttactgcccgccgctttccatccgtgagacagaagtcgccatcaaagaggtaaaggatcactttgaaagatcccttgcaaagaatctgcatctgacgcgtgtatctgctcctctttttgtgcgtccggagtctggactgaatgacaacttaaacggcgtagaacgcccggtagcttttggaatcaaggagcaggatgatagggaggtggagatcgtccactcacttgcaaaatggaaacgctatgcattgaagcgctacggctttcactcgggcgagggactttacactgatatgagcgcgatccgccgggacgaggacaccgacaatcttcactctatctatgtggatcaatgggactgggaaaaagtgatttccaaagaagagcgtaatgatgagacactggaatatacggtccgcaaagtttacgcagctttgaaagagacggagcattatatggcacgccgttataattacatcggagaagtcctcccagacgacattactttcattacatctcaggaactggaaaacctctatccggactgcacgccaaaggagcgtgaataccatttcgcgaaacagaaaaaggctatcttcatcaagcaaatcggaaagatacttacgtccgggaagccgcacgacggacgtgcgccggactatgacgactgggaattaaacggtgacatcatcgtctactacccagttttggatacagctcttgagctctcctctatgggaatccgtgtggatgaagatgcgttgcggcgccagctttcccttgcaggctgcgaggatcgtgccgagcttgatttccagaaatctctcctaaacggagaacttccgtataccgtaggcggtggtattggtcaatctcgtatctgtatgttctatctgcgtaaggcacacatcggagaagtacagtcctccatctggccttctgaggtggcagaagaagctgctacaggtggaatccagcttctctaagtttcctggtggagccggagttccggtcagagtcagattttgcttcaggtttagaaatgaggtactaaaaaagtggctgtatgaacactctcatgcagccactttttagatttttctttatctgtaaataatatcatcacgtcccggtccgttggataccaatgtgatcggatagccaattttctcttccacaaattcgatatacttcctacaattttccggcagttcttcataattcttaattccacggatatcgcatttccaacccggcagcttttcaatcaccggttttgctttctcgagaagataagtcggtggaaattctgtcgtgatctcaccatcaatatcataagcaacacataccgggatctcatccagataaccgagcacatccagtactgtaaaggctacatccgtcgttccctgcatccggcagccatatttggacgcaaccacgtcaaaccatcccattcttctcggacgccctgttgtcgctccgaattctccgccatctccgccacgacgtctcagctcatccgcttcctctccaaaaatttcactgacaaatgcacctgctccgaccgcactggaatatgccttgcatactgtcacaatcttactgatctcatacggaggaattcctgctccgatcgcaccgtaagcagccagcgtagaagaagatgttaccatcggataaataccatgatctggatctttgagcgtaccaagctggccttccagaaggatctcctttccttcttttaatgcttcgtgaagaaataaagatacatcgcatacatatggctcaatcatctttttatatcccatcagctcttcatagaggtcttccggctgaatcagcggtttatgatataaatgctccagaaggacgttcttctgctctgcaatacgtactaccttttctcttaacagctcttcgtcaaacagctcacttacctgaaatccgatctttgcatacttgtcagaataaaacggggcgattccagacttcgtagaaccaaaagagttctttccgagacgctcctcttcgtactggtcgaacagcttatggtaggacatcaccatctgcgcacggttagacaccttgattttcggcatcgggacgtctctgtccacaatcgactgaatctcactgatcagaactggaatgtccagtgcgactccgttcccgataacacttgttgtatgatcatagaacacaccggatggtagtgtatgaagtgcaaactttccatagtcgttgataatcgtatgtccggcatttgctcctccctgaaagcggacgatgatatcggcctgctttgcgagcatgtccgtaatcttaccttttccctcatctccccagttagcacctactactgcttttaccataacatatcctcctgtatgtgaatcttttattaccacctaagcattatactatatttttccttaaatgtacatttgaatttctgtttttcggaagtttttccactcgggcaagccaaaaagagccccctgcccctacatcagaggggcaaagagtcttaatacctgtccttcgatcttctctttcatcgttcttttctgtacgtctttaagcgtcacagaacgacatttcaaaagtgtctcctggaaatcctgttcaatatctgcaattacttcattattatagataaagactccatcctcaaaatggagatacaaactccggtaatccagattaatcgttcccacagtggccgtgtcgtcatcagagacgaaaaccttcgcatggacaaatcccggcgtatactcatagatctgaaccccggcctcaatcagctctttataaaaggtcttcgccacagcaaaagcgtatggcttgtccggaatgtgcggcatgataatgatgacttccattccactcttcgctacacgtgccagtgtcttcgtcatctcattgtcgagaatcagatacggcgtcataatgtgaacatattctttggcatggttcagaatgtggaagtacacctcctcgcctacattttcattgtcatacggattgtccccgtacggaaggacgtaaccgtccttcggatcgaactcctgcgccgggggcagcagatatttatcgtaatcgttgattttcttctccccgatattccacatctggagaaacatgatcgtaaggctccgcacagcatcgccctccagcatgatcgccgtgtccttccaatgtccaaaccgctctctacggttaatgtactcatctgccagattgatgcctccggtgaagccgaccttcccatcgatcacgcagatctttcggtgatcacggttattctgaatggtggacacgatcgggttgatcggattgaatactttgcagcggatccctcttcttctcaaataccacgggtagtcggacggcagcttggaaatactgcacataccgtcatacataaaacgcacttccacaccctctgtcaccttctcctccagaatatgccggatttcgtcccacatttctccaccttcgacaataaagtattccatgaagataaaatgctccgccttcctaagctctcgcttcagcgcctcaaacttatcttctccaagaggataatactcaagcctcgtattcccataagtaggaaagcccagatgctttccaagataataggaaagatttttatttgcgagcttactcttcttcatggcgtcaatgatttccatatcctggcgcatatactcttcggtctcatccttgagagtctccagtctctttccgatatatctcgtaccgatctgtgctttcacataaatatagaaaaaggttccgaaaatcgggagggccataatacacagcacccaggtcagcttaaaagccgggttttcctccgaattgatgatatagattacggcaatcgtaccgataatactaaagactccgtacagataggtccagttgtccgtaaggaaataaatcccgaaaaacatgacaagaatctggaccaagatcagaagaagaatgatagcagttctgccgtagatgacgctgaaaagtttcttttgtacttttctcttttttcctgattccaacttaattacctctgttctttttaaatacggtttattctaccacatttctatcccggtctcaactccaatcgcttcaaacattccttaactattctaaattaatattaagaaagtataaaattatgaatcttttctttctttttgaaaccgaaagtattacaataagaatagtattatgaatcaagagaaaggagttaccctttatggcaaaaaaatggacaaaaggtatcgtcggacttgcggcgatcggcgcggcagcggccgggattctttatatgaagaataaaaaggataatgaagatctggaagatgaatttgctgatgattttgaagatctcgacttcgatctggatgatgatttaagcgacacatccggacgcgaatatgtacctctgaacaatgctgtttcctctgaagaaacagatgcggattcctccagtgaagaaaattcatctgaagaaacagaagctgtatccgaaaatccagaggatgacaagaacgacaaggaagcttaaatcaccagaagtgccaaacggtacatttctggatgacaggcggtctctaaagttttggacagccccggactttgacttgccgccgatacaaatgaagcgctgctctggtaaccagagcagctttttcttttttgaaaaggaggctgataattttgacagattctgatcttactcttgtcccaagcggtcatctaaagccattggatgtgatctgcggctttcaggtgcgccccggatttttcctctccccgggtacaaccgtaattcctgggggagttaattttacgatccaatcccagcaggcgacgtcctgcgagctgcttctcttccaccgggaggcagagaagccttttgctgtcctgacgtttccggatacttaccggatcggttttgtctattccatgattgtctttggtctggacatcgaggagtttgagtatgcctatcggctggacggcccttacgatccccctagcgggcttgtttttgataagacacggattcttctggatccctacgccaaagcagtcaccggacagagccgctggggatgtaaaaacgaccagaaacacggctatcgtgcccgggtcgtaaggagtaattttgactggggagaacatagacaaccaatgatccctatgtccgatacaatcatttatgaactgcatgtaaggggatttacaaaagacgcttcctctaaggttaaggctcccggcacgtttgcgggtctgatcgagaagattccatatttactggaactaggaattacaacgatcgaactgatgccggtctttgagtttgatgaaatgcgggactgccgtctcttggatgagaatgaacttctggattactggggctacaatccggtcagcttttttgctccaaatacaagttacgcttccacctcggagtacaaccgcgaagggaacgaactaaaatgcctcatccgggaatgtcatgcccatgggcttgaggtcatctttgacgtagtattcaatcacaccgccgaaggtgatgagcgtggcccttatatttctctaaaaggctttgacaatcagatctactatatgttgacaccggacggacactattataatttcagtggctgcggaaatacgctcaactgtaaccacccggtcgtccagtccatgatcctgaattgtctccggtactgggtaacagaataccgtgttgacggcttccgctttgatcttgcctctattcttgggcgcaatgaggacggttcgccgatgagccggccgccgcttctggagtccctggcctttgaccccatccttggaaatgtcaagctgatcgccgaggcgtgggacgcaggagggctctatcaggtcggatctttcccgtcctggaaccgctgggcagagtggaacggaaaataccgggatgatctgcgccgctttttaaaaggagacagctatctgcttcgtgccgccgccagacggatcacaggttccccggatctgtaccctcctcaggggcgcgggagcaatgcttcggtcaactttttgacctgccacgatgggtttactttgaacgacctgtattcttataacgtcaagcataatgaggccaatggatggcagaattcggacggcaccaatgacaactatagttggaactgcggggtggaaggtgaaacagaagatcctgctgtcctcgcccttagaaaacgcatgatggaaaatgcctttgccgttctgctctgcagccggggcaccccgatgtttctctcaggggatgaatttggcgacacaagatatggaaataataatccatactgccaggataatcccatctcctggctggactggactcttcttgaaaagaaccgtccgctctttgagtttgtgaaatatatgattgccttccgcaagcggcatccagccatccggatggatcttccttccgatcgcttttcctttccatcagtcagtcttcatggtgttcacccttggcaaccggtactgaatgaagactcccatattctctgtgtcttattttccgggtttgaccaagaacaaacagaacaggataccgtctatcttgccattaatacctactgggaacccgccagccttttgctgccggatcttccttttgaatggtgctggcagatcgcagtcaataccggagatccttccggccctgccttttcggaggatacaatgccggaggcatctcacaccgttcttcttggcgaacgttctgttattctctttgtcgcaaaaagaaggagtgtctgataaacaatcagacactccttctttttttcgtgtgccgccgctaacctacataggccagaagccccggcatctctttcgcgattctgtcatcgagctttgcaatcatttcttcccggtctctcggaagcactccccttacacggaattctatcatatcgtggaatccatcatagatcgcctcatgctcccacggttttaacagctccagaagtctcctctcctccgtcagattttctctttcatccgccggatggaacctgccttttctgatttcctgatacagaggcgccctttcatggagaaacatggaaaaattaatcattctatagggctgtgtccggttaaaaaactcggcagtatgctccgcattttcgatccctcttccctttccggcaattccagtcataaagtgagcatcaaaaacaagacctgctgctttcatcctgtcaatctcatagtacgcctgctccagcgtgtggtctttgttcataaaagcaagtacatcatcgagcccactttcgattcccagatacaaatgccggactcctgcatcgtaaagctgatgcagctctgtgtcacttttcctgctgatatctgtcacagtcgcatccatatgaatactctgacagcctgggaaatagaaatgaattttctcccctatctttaacagtgtttccgtggagagtccgaacgcattgccgtcaccaagaaaaacggtcttcgggttgccgtttatccggctcaccctttttagctcttcttcgatctgatccattgataattctctgaacttcagatgtttaaacagtgtgcagaacttacagcggttatatgcgcaccctacctcaaccggaagcatgaaagaagctcgttccattggtcccctacagatctgtccctcataattcatggtatcacctgaacctttcctgatttcattatacaccgaaaatcagtagaaatgcagaggaatctttgagaatctttcgaaatttttaagaattttgccaaaatcacttgcagtcaaaccatgttctagtatagtatattcatgttttatagtttgcaatacaaaggaggatgttatgtcaaattcaactcacccatctcaaggcaggcagtatgcctctgtgtttgatctgaatggggttccccggtttggtcaggcgctgccgcttgcgctccaacacgtggttgccatgatcgtgggatgcgtcactccggcgatcattgtatccggtgtggctggcttaaacgaacacgatcaggtcattctcgtacaggccgcattgtttgcgtccgcaatcagtaccctgctccagcttttcccattcatccgcttcgggaaattccagcttggctccgcccttcctgtcatcatgggaatcagttttgcctatgtgccaagtatgcaggccattgcggagaccgctgacgtcggcacaattcttgccgcacagctcgccggaggattcatcgcgattttggtcggactttccatccagaaaatccggatcctgtttccgccgattattaccgggactgtggtctttaccatcggactgtccctttacccgaccgccatcaattatatggccggcggtacatcaagcccggattacggctcctggaaaaactggcttgcagcattctttactctggctgttgtcgtcggactgaatcattttgcaaaaggaacattaaagcttgcttcgattctgatcggcattatcaccggatacatctttgcttcgtttctcgggctggtagacctttccggtattcagtcagccggatactttcagcttccaaagccgctccacttcggcctgaacttcgatccttctgcctgcatcgcgatcggcgtcctctttgctatcaactcaatacaggcgatcggcgacttctctgctactacggtaggaagtatgaaccggcagccaaaggacaaggagcttcagggcggtatcgtaatgtacggtgttaccaacattttgtgttctctgatcggtggtcttccgactgccacctacagccagaatgtcgggatagttactacaaccaaagtcatcaaccgctgtgttctcggacttgcggccgtaatccttctgattgcaggattcgtaccaaagttctccgcacttttgacgacgattccacagtgcgtgctgggaggagcaacgatctccgtctttgcttccatcgccatgaccggaatcaagctcatcatgctccaggagatgaactaccgcaacaccgccattgtagggttgtccgtagctcttggtatgggaatcacacaggcacctgctgcccttgctacattccctgcctgggtaacaactatcttcggcaaatctccggttgttgtggcaactctggtggcaattctgttgaataccattcttccaaaggagaaaaaagaggcttaatacattgattgcatcgtaaaatagcgtgaaacaaaagagccatagtatgccggtttctccacataccatggctctcatttcttcccgccggataaccttctattctctgtgcatggaaaagctgtccatctgataatggctcagattctcatggatacctctatcgtccgcctgactgataagggaatccctgctctttttggaggaaaactgatcattatatgcgctcggtcctcccacacatcctccttcacatgccattccttcgataaagtcagccggaagcttcgccgcccgcatcagaagtaaagctttcttgcactcggccgcgccattcgccttatggactttcacatccacatctgcattggcctctttcatactctggagcaccgccgccgtcacaccgcctgcattggcaaagcgtttgccaaatgtggaagcgatctgattctggttctcacatggctttagctccacatttttcgcccgcataatagcacgaatctcactgtatgtaagcacatagtccgcattccctttgatctgctggtctaccacctcagattttttcgccacgcatggcccgataaatacggtcactgcctccggatcctgtgccttaatcaatctggacactccgcacataggagataccgtcgtggagacacagtccgcaagctgcggaaaatgcagacgcaccatattgacaaaggccggacagcaggaagtcacttttttctttccttctttgtaggcttcggtccactcttccgcctcatatgcagccgtcatatctccaccaagtcccacgtcatagaaatcctcaaaaccgacttgcttcatcgcttcggcccaactatccatcgtgatgtccggtccgaactggccttctgtggcaggcgccgccatcgcatagacgtgctttcccgacttgatcgcctcaatcaccggtaccataaaactcttcgttccaatcgcaccgaacggacaactgtgaatacattttccgcatcggatacatttgtccttgttgatgaccgaaagcccgtattcattgtatgtgatggcatctacagggcaactgaacttacatggacgtttcagatgtgcgatcgcattatacggacatgctttggcgcactgtccgcactccttacacttggaggcatcaatatgggaacgaaatcttcccggctcaatagccccaaacttacatgcgttgatacatgctttaccaaggcagttctggcagttctccgtcacggtataactggaaatcggacaatcctcacaggcagaattgataacctggataatatttccatcatcctcaatccccggagccttcccttccgccagacgtactctctgacggatgatctctctttccttgtagatacagcaccgaaactgtggaagaggtcccggaatcagtctctccgcaatatgatctctttcctcgtcaagcttcccttcaaaagaaagccgcgccacttcatttaataccttatgtttgattgtgattacattttcatctgcgtacatgattttctctcccgtctttctcctactcttttctcaactcgatgcctatattataaaagtttccaggtcaaaaggaaagtggtacatatgtatttattcagaaacacattgccgtttgaagcaaggatgctttcgcctgataatccgtgatccccgccccactgttcggatgaatcagggagaacacaatatctgcggcaaaagccatcagaagcaggatacataaaatcctcgccgtccttttcggtatccgtctgtaaatctcatcaaaaaaaggagccgcaatataaataaacgcacagcctccaaggccaaacaccaacaacccttccgcacagatccggccatgaagattcagaaaatatcctgtataattccaccagtacattcccttgatctcccaaagcaaccatgcggatagatactcaacaacaccgcagacaacaatagcaaggaaaaatgtcagcaatggcttttttgcaaatcgtttcagcagtacaataaccaaaatccctcccgtcccatagataggcagccacggtccgtgaaagaagcccctgtttacaaaaacaccgtctccgaacaaatgcaaagaaacctcccacagccatccaatcactgaaaaagtaaaaaagatcaaaacaagggaactccaggaataggctctgtcatattttaaccgaatccattttcttaccttgggattatagagcttatatctttccaccggatactcttccagtcctgtatcttcatatagttgtttatcatccagataatgaattcccggaatctgcttttcaaacgcctcttttcgaagttctacataaagttctgcctctgtcgtctgcatataaggtgtaagaaagactctcctcaaaatcccaaaagtaaacagatccaaaacataccagccaaggaaagacaggtcaaaagcaaaagctctcatcttgtttcctttcatcatctgtctcgagagaagaaacgcctcccgatgcggaatatccggattctctgccacaatatacggtatcatcttgtaagaatatcttttaataaagcctccgataatcgtataatcccataaaaacagaaagatgtattttttcagcatgatcaacatcgtgtttttccagcgatttacacgccacggaaaagtgagcctcccaagcctcacctggccgtatatccggttctccagcagaaatctgcaatatcccacttgaagcacgccggaaataaaaacctgaaacatcatcataagaagggccccgatcaaaatgagaacaccttccgtaatcttatctttgaaaagaacatcgttcagtgcattcagtaagccaaaaaaagccgaccgctccttcgtcatatgattatatacaccggcgagcaccccttttttcggtgtataatgttcacctaaaaagcccaagatctgtcctgtttgtgtgtcctcactctgtttgacgcttgagaaccagtcattcaaaatatgagcattactttgggttctaacatttacatccagaaccatggccactccctcaggcgtccgataaatcaccctcatccctccggccagaaaagccagcatcagactaatgccgatgagcctccaccagttctttttcagagcttctctgccccgttttttcagttgctttctgttccacatccattttccctcgtttccattcctttatcttttgcagccgctccttgacctgatgttccgccccttcatccgtcggtgcatagtagatccggtcttttaaactgtccggcatacaccgcatacgggtcagcttttcctcggtattatgcgcatactcatatcctttcccataattcagttctctcatcagccccgtaggcgcatttctcaacaccaacggcactggctctgcgggctgttctcgcacatcccgcctgcatgactcacacgcacggtacaacgcatttgattttggcgccatagcaagataggtgactgcatgtgccagatggacatcgcactccggcatccccaggaaatgacatgcctgataggctgccaccgctatctgaagcgctccactgtccgccattcctatgtcttcgctggcaaagcggatcagcctgcgggcgatataaagcggattttccccaccctccagcatccggcacatccagtaaatggccgcgtccggatcactgtttcgcatggatttatgaagcgccgagatcagattatagtgctcctccccagtcttgtcatacagaagagatttccggctgatacattgttccaaacactcgtccgtaatccggatcccttttgcgctcatctctccgtttaataccgccatctccagcgtattcagcgcagtgcgggcgtccccattggcaaaggcgcagatagcttccttctggtgtttttgaatcataatatgctgtccgccaaacccggatggacttgtaagcgcatgatccaggagtttcatcaagtcctttggctccagccctttgagaacaaaaaccttacaccgggagagcaaagcagaattgacctcgaaagacgggttttccgtagtggcaccaataagaataatacttcccttctctacaaaaggcaaaaaagcatcttgctgcgccttattgaagcgatggatctcgtccacaaacagcacagttcgtctgcccatctgacgccgcatttccgcttcattcattacttctttgatctccttgatgccacttgtcaccgcgctgaaattgacaaactctgctttcgtctttccggcaataatacttgcaagagtcgtttttcccactcccggaggtccccaaaagatcatagaagaaatctgatctctctcaatgagttgtcttagaatctttctctttcctaccagatgctcctgccctacaaagtcttccagcgaatccggacgcagtcttgaagcaaggggcgcagtccgttctctgtcgtcaaatagtgataattgttccatcttcctccctgcctttcctgttttaagcgctttctgacatactgcttctgcactgccatccatgtccgattatgactgggacatagtaaaaatctgctgcttcagatatggttcaaaatacgctttgatcgtctccaacgtgtattcctcccccgtggctttcggtactccgctttttgccgccagttcttcggtataatcttcaagcggatacaccccataacctacgaaccccggctcataatgcatgacaagcggttccatcgaatattgctccacacggacctcgccggtgtccggatctttctgaaatgtaatatccgccatcccctccaaaagctgggatgcaccctgctgcccggaaacaaaatttccaagagaataatataccagcatcttcttgccgtccggacgctccatctccccgtaaggacggataacgtgcggatgcgtgccgatcaccacatcgacaccaagacttgctaaatattcgatcctttgcttcgtggccttgtccggctcactttgatattcaaccccggaatgaagatataccattacgatgtccgcttctgccttcgccttttccacatccgctttcactgtctcttcatcgtagacatccacggcataagtttcattttccggtaccggagctccgatattaatgagtgtagtataattcatcatagcgattttaaacgccttcttctcaatgattttcactctgttttcttgttggtccttggcgcttttgtggataccaagtacgacaggaggtgtttccctggactcccagaacgtaagtgaattcaaaataccttcttttcctttatcgtaggaatgattagtagacatagtaatgacgtcaaatccgagattcgccaaagcctgcccaccctcctgcggcatcccaaacgttggatatccactcgtctcctcgtgagtatttacaatcggtgtctcctggtttactacagccagatccgcggcttctatcttctctttcacaggctcgtaaatcgtatcgtaattccattccccgctatccttctgtccgtcaaagatcacagtgtcatggtaaaaatgatccccaaccgctaccatatgaagcgtatgttcttctttctcttttgccttggcttcggcctttttcctttcctctttttcttccttttccttccgaatccgtgcctgcgtttctaccgcctcctgatggcaggaccggatagcagagatcacaaaaatgatcagtgccagaacaagcatcatccccgcaattacaattcttctcttccagatcagtctcctgcgccgcttctccttctgaatctttccgcgccttgcggcttcccttcttttttcttcttctgtcaatagtactcctcttttctcttttgtaacattcctttttctgatcgtgatagcatgactctgttctgatttgtcatgtttcacgcacgggaatcaaataatacttcgcgccgcttgattccatgtgtcacatatattataccatggctgctttccaaaatgtgggttattttccgtaacagttcagacatgcagaaagcagggctccggcttctggatccaccactgcggatctgtctgccggccccctgccaatgagctttcatttattaagattcactttaaaacacgtattcgttgagacggcgaaatgcttcctgcactctgctaaacggcagtgcaaggttcacacggatgccgtattctgcgtggaacggacggccgtcctgccatgcgactccgacatcccatccggctcttaaaagctcgtccgttgttttcccgtgcttcttgcaccattcctcacagttcaggaacaacatgtaagtaccctgcggcttcgcaagactaatgccctcaaaatgctccagaatgtaattgtacgcataatctacattcctggagagtacctggcgcagttcatctacccactcctgtccttccttctggtatgctcccacaagtgcatgcatggatagaacattcatggaattgtagtgacatttgctgctgcttgccagcacccgatcccttaaatacggatgatagatgatgtggtagcttccaattaaccccgcaagattaaatgtcttactcggcgcatacagtgcgatcgtacgattttttgcgtcttcactgacagactgtaccggtgtatgatggtatccttcgagaatcagatccgaccaaatctcatccgcaatgacaatacagtcattctccttgtaaacttccattgctttctgaatctcttccggctcccagactcttcctgtcggattgtgcggattacagaatactgctacgtggatcttgttctccttgagcttggcatccatatcttcatagtccattctccagactccctgctcgtcccgtttcatccggctatgtacaatccgatatcccgctccttcaatactctttgtaaatccgatataagtcggactatgaacaagcacgccatccccgtgggaggcaaacgcattcagtgccgaaacaagtccgccaaggacgccgttttcgtatccgatttcttcttttgtcagcccttcaaccccattccgcactttctgccagttgataatcgcatcgaaataagcgtctgacggtccaaaatatccgaaagccgggtgggaaatccttttctggatggcctcaataatcgacggtgctgtggcaaaattcatatccgccacccacatcgggatcagatcaaaaccttccttcggcccacccggggcaaagccgcctcccttccccggaagatccaccgcaatggcgtcctttccccgtctgtccataatggttgtaaaatcgtacttcatgttgctaaacctcctccatctttgtatcatataaatgacatgcggtccagtgcccttttttgacttccctcatctccggctcctcttggcggcagatctccatacagtttttacaacgtccggaaaaccggcatcccgcaggcggatttaccggacttggaacatcgccctctaaaatgatcctcttacgccttctggagacgtccggatcagcaatcggaaccgccgtcagaagcgctttcgtataagggtggagcggactgtcgtaaagctgtgacgcttgtgaaatttcgaccatctttccaagatacattacgccaatcttgtccgaaatatgcttcactaccgaaagatcgtgtgcaataaaaagcatcgttagtccctgttctttctgaagcttcatcagaagattgacaatttgcgcctgaatcgatacatccagcgcagagatcggctcatcacagaataaaaactttgggttcactgaaagtgccctggcgatcccaatccgctgtctctgtccaccagaaaactcatgcacatttcttgccgcatgttccgcagtcagtcctaccatctccagaagctcaaatactcgttttcgctcttcctctttatttgcggcgagtctgtggatctggattccttctgctattatatcataaactttctggtgtgggtcaagagatgcgtacggatcctgaaaaatcatctgtacgtcttttgtaaacgcaaatctgtcctttgtagacatactatggacgtcttttcctctaaaatacacctcgccgccactcttttggagaattccgatgcaggtttttccacaggtcgtctttccgcagccggactccccgacaatcccaagcgtttctccctgaaaaatagaaaatgaaacgtcgtccaccgcttttagatatcttcctcgaccagccttatagtactttttcagattccttacttccagctcgatcttttttgatgtaccatcattcatcttcagtcctcctgtctatcccaaatggcacgccttcccggttcgcccgacgatccaaaagccagcaggaaacctcgtgtccgtcttttaaatcccatgtcggcggctcatgctctttacagatcctcatcccatacggacacctctgacagaatgcacaccctttcggagggtttgtcatatctggaatactgccctctattgtcatcaatgtctgaccatgatagtcgatccggggaacggatttcagaagcgcccatgtgtacgggtgagacgcatgatagaaaatatctctgcaccgccctctttctacaattttccccgcatacatgacgacaatacaatccgcaacgtccgctaccacgccgagatcatgtgtaatcaaaaccacagacatatgtagtttcttctgaagattcttcaaaagctccataatctgcgcctgaatggtgacgtccagggcggtcgtcggttcgtccgcaattaaaagtttcggccgcgtcactagcgccattgcgatcatcactctctgacgcatccctccagacagttcgtgtggatatttctccaggcagttctttgtgtccggaatcccgaccagctgcagcatctcctgtgcccttgtccgtttctcttgtttggacagcatcgtctcgtggttatccagattttctatgatctgacgtcctactttcatggtcggattcagggagacaagagcgtcctggaagatcattccgcactctttcccacagaacgtattccactgttttttcgtatactccaccacattctctccctggaagaagatctgacttccttcttttatttttcccggctttttaatcagccccataattgattttgcggtcacagtctttccacagccggattctccgacaatggctgtcgtctggtttttctctacggtaaacgatacgccccggactgcctggacttcccccgcataagtaaaataggatatcttaagatcctgtactcttaataatgtgtccattcctcttccctcctatttcacgatcttcggttccagagccgttctcagtacgtcgcccagaagattgaaacttaagacagtcagcataatcagcactcctggcagaattgcaagtcttggtgtgtccagaatatgcacctgagcactttgaagcatactgccccaggatgccaccgggatctgtaccccaagtccaaggaaactgagcgaagattccatcagaatcgcgctcgccactccgagactcgccgccacaactaccggacctaaaatgttagggataatgtggttaaaggcaattctaagacttcccgctcccaggttttttgtcgcgatcacataatccctctctttgactgacattgtctcagcccgtgtgattcttgccacctgcgcccaggaaaaaaggctcagtacgaaaatgagcgtcaccagtcctggctgcaaaatcgcattgagtacgatcatcagaagcatacttggaagggccagaaaaatgtcagtaaaccgcatcagaatcatatccagctttcctccgatatatccggagaacacgccgatagttgttcctatgattaccgtaataaacatggagcaaaatccgacaagcagagagacccttccaccgtaaagtgctcttgtcaggtaatctcttccataatcatccgtcccaaagatgtggctcgctgacatgccctgcatcttctgagaaatgtcgatttcgtatgggtcatacgggcttaatggtgccagcaagacagcgatcagaatgaccgataaaaagaccatgctgaaaagcgccgccttattggagagaaattctttccggatttctttccacacactgtgcctgtagcctgtcacctgttctgtttctttttcttccagtctctggaaggattgttctgtaattgttatcttatcttccatttgagctgtctatcccccgttttatccttggatctgcaaatgcatagagcatatccgccgcaaagtttccaataacaaggatgaatccggaaagcatgacatacgccatgataatcggataatcccgtttcccgatcgcctccattgcaaaggtgccgattcccggccatccaaacacactttcaatgataaacgaaccacagaccagcgtagccagattcattccgatcagagtgataatcgggagaagtgtgtttttcagcacatggtggaacaaaatctttgatccctttgttcctttcgcctgcgccgtgagcacatattcctctcccaactctcctatagtactggagcggatataccgaataaaggttgccagatttcccagacttagcgtgatacacggcatgatcatatgaaggaatgtatcccatggcgtgtttactcctaccgtattcattccgctggatggcagaagatgcagctttgcggtaaagacaatcaccagcaccatcccaagccagaaagacgggatggacattccgatataggacaaggagctgatagcattatcgacccaactgtttttccgatacccggaccagagtcctagagggatcgcaagtacaatggacaaaaaaagcgccgtccccatcaaaagcagagttgcgggaagccggcttaaaatctgtggcgtcacggaagtacgattggcaagggagattccaaaatccccttttaccgcctgtttcagccacccgagatactgctccggcatacttttatccatccccagatgctccagtaccgcctctttctgctcatctgtcatctcctgtgaaatatacatactggaaatatctcccggcgcaatataaatcacggcaaaggaaaaaaaggaaatcaaaagaaggacgaccgccagttctacaatttttttcaaacagtatttccacatgttgtatcctttctgttataaaacgggggatgtcttaaccaagcagtcaacacagcccccgttttctctattctactttcatagaaagccagtccgcaaattccggaacgattggagaagcatccagacccgtcacatttttctgtgataccataacatagttcgtataggtcagtgggtattcccagtactctccaagcgcctgatcctgaagctcataccagagcgtcttggattcgtcggcatttgccgttgcgtttgctttgattgccatgtctgtcgttgcctgactgaagccccatgcctctgagttcttcagataggaagccgcctgacctccactggttcccctctcagagtcccatccgttcgttccaagatcccatgtattctcttgtccgctgttatacatgattgcgaagaatctctggaagaaagacgtggaatccagaccttcaatgctcagattgacgccgattttggcaagctgctgctggatcacggttgcgaccgcctccatattcgcacggtccgcattgtaaatgtaagtaagcgttttccctgagagcccggaggattcggccagctctttcgccttgtcaagatcctgtgtatatcccgcacaatccgggttgtagtctacctggtccggtgtaagcaggctgtttgccggagcggcaagctcgtcgcttccgtaggccgcatccacgatttcctgcccgtccagcgccaggaagagcgcctttctgccctcatctgttaagacatctttgtttggtccgtgaggatttacctgtaagtaatttaatctggattctgtgatggagtaagtattatattcgtcagaatcactgtatttttccaattcctcttttgtcgtaacacgcatgtaggaaatttctccattttcaaatgccacctgtctcgaacttccggatcctgtatttctgagaacaatctttttcacgctcggatcgccccggtagtagtcgtctcttgccacgtaaacaatactgtcgtcattgatctcggagaccgtatacgctcctgacgtcgccatatctatttcattaaaataaccgctgtcatccaccttggacggatcgttgtcaaacgcatgggacggcataaccagtaccctgttagataaggtggttacatagctggcgtaaggctcaggcaaagtgatctccagcgtcttctcatcgatctcattgaattgtaccggttttccattgatggtattgtaagacgattttccgccggatgaacgtcccgcataattaaaggaaaacagaatatcctgtactgtcacaggttctccgtcactccagttagcgtcctcgttcagatggatcttgtatgtcagtccatcttcggatatctccagactgtccgccaggtagtactcaattccatctttcgtatccaaaaacaacggatcgtagatcggcctcaccatagaagtgtagtcgtcacttgctgtatcaggttgtaaggaatccggcatataactgattgccattgtaaacgttcctgcttccgtgtttttcttggtactgcctccggatccaccgtcaccatcttgcgaaccaccgcatcctaccagcacccctgctgtcatcgctgttaccacgagtatagacagcaattttttctttctcattcgtcgtgtcctccttttgtgttataataattcttatttagtatatattgtatccctctccgtacacaaattgattttttctctgaatcattttacttatttgtcaaacaaataaacagggtggaaattccgtaaagttttcactcacagaacttccacccattttcttttctaattattcacctttcatcttataacagattatttcgccattttgctccataaatacctgatatgcctcctaggctctttcatctgtctcataagtataattcttattcgcaacccattgatagagatctgtctctacccggattggaaaatcctgctccctggacaaaatcgctgctgtctgtaaagctctcgtataagaagaagtcaaaatctctcaaaatcgtccttttcgttaaatatcgctacacttgcgtctttccactcctcaaagaaatcggcaaatgtcatatatcgatccttcttgtcaggactgacagctctggccgcaaccttgtaacttttctcgtttaattgccaagcagaaaataaacatggaagaaactgattgtttttatatctccgggcaatttcttcatcagaaaagtaaccaaaacattcaaaaatcaatgcaccaagagtaaaaatatttgtctgctcgtcgatagcacttccttttatatattcttctggtgctttaaggcgttttgttccaaaccactccaatcctttatcgttaataacaggtgccatctgaaagaaatcaatatcacaaatcgtagttgtgtctgtcgaaaaatcatacataatacttccatcataaaaatcaacagcaacataaccccttttacttacattctgtaaaaaagaaaacaacacatctactgcatctaattttttaccaactggtaattgcttgaatttatctttagggcttttcagagtagtatctctttggtatttatcaaaattccagtgatcaaataagcactcgccttttgcccattcaaaaatggtaacatagaactgattatattcataatcttctattattttcactaaatgaggatgtcttaaatcatagtacagatgggcagactgttttaatatttcaacagattcttttggtgaaacctctgcctcaagtgtattgactcccgcaattttgcaaaaatattttttgtttctattctgcataccaatacaaatacatcccgaacccgtctgatcaacaacccaaaaagccgtaccatattttttcagccaggtaaaatcatgtaactctttcagtctgaattcgatagaatcaagtttatttataatcattcttcctcctaaatctgacggagggttatgccatgctgttccccctccaattatttttcatgtaacaaatgtttttcatattcatttacaatcatccccttttcaatttcatatctatcttaacgctatcagagaattaaaaatatagtaatcttttttctctcaaacgtgagctgattataccacagatctatatcattatcaattaaaagtatgaggtagcattgccatcggaagaacagattaaaaaagtaatattacaactcactctcaacacagagcaccgtccacatgtcccaaggagatatagaaaaataagcggcactctgtttttacaaagtaccgcttataattaacaaataatcaactaatgaacgagtatttcccgttttttactactttcaccagcttctaaaaatcccgtaaatccggcgtttattagaatttaccagccttagcggcttcctcaatggcaactgctaccgctacggtcattccaaccatcgggttgtttcctgctccgataagccccatcatctctacatgggccggtacagaagaagatcctgcaaactgtgcgtcagagtgcatacgtcctaatgtatctgtcataccgtaggaagccggtcctgctgccatgttgtctggatgaagtgtacgtcctgtaccaccgccggacgcaacagagaagtatttctttcctgcttctacacactcttttttgtatgttcctgcaaccggatgctggaaacgtgttgggttcgtggagtttcctgtgatagatacgtctacgccctctttccacataatcgcaacaccttcacgtacatcatttgctccgtagcagtttactttggaacgaagtccgtcagagtatgcggtacgggaaacttctttgagttctcctgtataataatcgtactctgtctgtacataagtaaatccgttgattctggaaatgatctttgcagcgtcttttccaagtccgtttaagataacacggagaggttttttccgtactttatttgctttctcagcgataccgatggctccttccgctgccgcaaaagattcgtgtcccgcaaggaacgcaaaacagtccgtctcctcttccagaagcatctttccaagattaccatgtcccagacctacttttctctggtcagctacagatcccggaatacagaaagcctgaagaccttctccgattgctgccgctgcgtctgccgctcttgtacagccctttttgattgcgatagcggcgcctacgatgtaagcccagcaagcattctcaaaacagatcggctgaattccttttacctgattataaacgtcaagtcctgcatcttttgtaattttctccgcctcttcgatggaagcgattccataactgttcaatacagcgttgattttatcaattcgtctctcatatgattcaaataaagccatttctaaagtcctcctctcgcctattcctgtcttgggtcgatgatcttcactgcatcatccacacggccatactgtccctgcgccttttcccatgcttcgttcggtgtgtcacctttcttgatgaaatctgtgaatttcccaaggcttacaaacttgtaaccgatgatctcattgttttcatctaatgcgattcctgtcacatagccttctgccatctccagataacgaggaccttttgcaagggttccgtacatcgtaccaacctgggaacgaagacctttccctaagtcttccagtcctgcaccgatcggaagtccatcttcagaaaatgcgctctgtgtacgtccgtaaacgatctgtaagaaaagctctctcatagcagtattgattgcatcgcagacaaggtctgtatttaatgcttcgaggatcgtctttcccggtaagatctcggaagccatggcggcagaatgtgtcataccggagcatccgattgtttcaaccagtgcttcctggataattccgtctttgacattgagtgtcagcttgcatgtaccctgctgaggagcacaccagcctacaccgtgtgttaaaccggaaatatctttaatttcttttgcctgtacccattttgcttcttctgggattggagctggcccatgattcgcaccctgtgctactggacacatcatttctacttcgtgtgaataaatcatctcaaggactcctttcaactatatgtaatctctcttggaggccgtcttttgtacagcctatatccgtgttaattttctcacaaaaaggaggtttcgtcaatcagctagttgcacaaaacatctctttttttacctatatagataccactatcttacctgtccgcagcgagcagacattcccgcagaagaatgagtgctcttgccactgcgtactcacgattcttctgacgattccccgtaaagcggaacttctctacttttgtccgtcccttgaccatgcatccaatataaacaagtcccaccggcttttccggcgttccaccttccggaccggcaattcctgtcaccgcgatggaagcatccgccccggataaccggcaagctccttctgccatagcccgtgctgtctcttcactcactgccccatactgctttaaaatctcatgtgacacatgaagaatccgttcctttgcctcgttagaataggtaatgtgggcttcattaagaacactggacgcacccggcacatttacaagcctgccgcagagcagtcctccggtacaggattccgccgtcgtaactgtcatctttctttcctccagcatctggatgacagcttcctccaatgtcacttcctctttcgtcgtataaatgtgatcgccaaaacgttttttcagttcctccaacatgggagccatcagacacttcgccgactcctcgtcctttgccttggctgtcacccgaaaatgtacttctccggtttttgcgtaaggggcaagggtcggattcgtctgggcgtccatcaggtccgccaccattgtttctgccctgctctctccgatggcgcatacctttaccatactggagtaaatcccttccggttgaaggtcagacagatacggagcaatctgagtttcaaacatgggaatacactcatttggggggccgggaatcaaaattgccctctttccttcgtagccgctgccttcgtccccaataacaatcagccctggcgccgttccattctgattctctacaatgatcgctccttccgggataagcgcctgtttccagttattctctgtgatcttctccccgttatgaatcttttggaagaattccatgatccgctcttttgtgtgggcatcctcacagagcgcttttttgaatacctttgccgtcacttcttttgtcagatcatccttggttggcccaagtcctcctgtaagaattacaacgtcggaccgctccaacgcgcggcgtatcgtatcttccatacgcgcttcattgtcccctaccacactttggtgatataaagacaaacctagcagagcacacttctctgctaggtaagctgcattggtatttacgatattgccgagtagaatttcagtaccgacggaaatcaactctgcaaccatcttacatacctccttttgtcaacacttctttgttctttgcaatataatcaatcagggataccacagtcaggatcagagccaggtagatcagcactgtctcaatcattaccgcggtatgtcccggaagatccagaatcaaaaagataatcataaacatctgtgaaaccgttttaaacttgccccaatagcttgcggcaatgacaatcccgctgtctgacgccaccagccggaatccgctgatgatgaattcacggctgataatgacaatgacgatccaggccggaagtttgtccatcggaatcagacagatcatagccgctcccacaagaagcttgtccgcaagcggatccataaactttccgaaatttgttaccagattgtattttcttgcgatctttccatccagcatatccgtaagacttgccacacagaaaatcacaagagcgatataattgctgtactgtccggccagatccgtcagcataaagacaacgaaaaacggaatcataatcacacgcagtaccgtaagtttgtttggcagattcatttacatcaactctcctatcaaatcatattcgcacgcgcctgtcacccggactttagcaaagtcacctgacaacagttccgtgtccgtatttacgaaaatcagcccgtctacattcggcgcgtctttgtatgtccggcctacataggcattttcgtccgcaacctttccctcgatcatcacaagcacttcccggccaatcatctgctctgcctggtcaaatgcaatttcctgctgaagctccatcagctctgccctgcgggcttccttaacgctttcttctacctgatccggcatctgtgccgccggggtgccgtcctctgctgagtaagtgaacacaccaagccgatcaaacgccatctcatctacaaaatccatcagctcttcatgctgctcctttgactcccccggaaatccggtgatcagcgttgtgcgaagcgtgatgtccgggatttcttcccggatcctggaaatgatatgaataagctcctcctttgatgtacggcgccccatccttttcaggacgtcgtcgctggcgtgttgaatcggaagatccaggtaatgacagatcttcggctcctctttgatcgtctggatcagttcttccgtaatctcctccggatagcagtacaaaatgcggatccagcggataccgctgattttgcagagccggcgcaaaagctccggaagttttttctctccatagagatccttcccataaagcgtcgtctcctgtgctaccaggatgatctccttcactccgtcatccgcaagctgctttgcctcccggagcagatgctccatcggaacactccggaaattcccccgaagctttggaataatgcagtaagtacaatgcttatcgcatccttccgcaatcttgagatacgcataatgccctcctgtcgtcaccatgcgatgagtattcacaagaggaagtgtatccagcggctccatttttaaataggattgccctgccaacgccccgtctaccgcgtccaggatatgcccgtaagaagcagttccaaggacagcgtccacttccgggatttcctttgtgatttcctcccggtagcgttcagccatacaccccgtaacgatcagcgctttcaggctgccggacttcttatactctgccatctgaaggatcgtttcaatgctctcctccatggcatcatggataaaacaacaagtattcacaataatgacatccgcatcctcctcggtgtccacaatctgatatcctctggaggcaagaagtcccagcatggtctcagagtcggcaagatttttgtcacaccccagtgagataaataagatcttcatgtattctctcctaacatttcataaggcagatacttgtttcaaaagcacctgccttgttgtctcttattcttcggtatcttctccgattacctttaactttccactgttcatttcatcgatcgcaacggacaacggcttttccccgtcttttgtcggtacgagtggatccgcatggtcgatcagctgtcttgctctctttgcggtggcaagtacgatggaataccggctgtttacaattttggtatctccctcttctacgtcctgattcaccactttcattaaatctgtataagatggatgcagcataacatcattctcctttcttctacttttacaattcatttaattcttttctgattttcgagatgaactccccattccttgcgacttttttcttttcattctggatcaccgaatgaagctcgtctacacagctctccagatcgtcgttcacaatgagacagtcataatcgtcaattccttctgcctcctctttcgcacgggcaagcctctgttcaatcacttccatggactctgtcccccgtccgatcagacgtctgcgaagctctttggcacttggaggggtaataaagactaagagcgtatccggaaatttctccttcaccttcagcgccccttggatttcaatctccagtatcacgtcttttccattctccaactgctcctccacataagagcgcggtgtcccataataatgattaacatatctagcatactctattaattcgtcttgtgcaatcattttttcaaattcttctgtcgctttgaaaaaatattctcttccgtccacctcgccttcccgcggatttctcgtggtggcggaaatagataaggcgtaatcatcgtatttctccatcaggcgtttcattgccgtccctttacctgctccggaaaatccggacaaaactgtcagtatcccctttggcatcgttttcatttccctttcctgctactcaatattctgaatctgttcccgtactttctcgatctccgtctttaaatctatcccgtaattggacaccgtcaggtcatttgccttggataaaatcgtatttgcctcccggttcatctcctgggcaatgaaatccagtttccgtccgattccctctcctgtcaggagtgtggccctcatatggtcgatatggctctttaaacggacaagctcctcatctgtacagatcttgtccgcaaaaatcacaacctccgcggcgatacggctttcctcgatctgagtatccgctaggagctcccttactttttcctccagattcgcccgatactcggaaagaatctgcggggaacgctcctcgatcttctccacaagggctttcatggcatcaagctttccggtcagatcgtcgcgaagcttctccccttcggtttctcttgcctttacaaactgcacgcaagcgccgtcaagggcctctttcagtccgttccacatctcgtcttcgtccacatcctgttcttccatcgtaaagacctccggataacgggaaagcgaagaaatccggacatcattttccaaattgaatttctcctccatctggcgaaaataatccagatattccgctgccagcgcctcattgtactttaaggacatctgcccctgggagagatcctcgtaggatataaagatatctacctttcctctctgaacgtacctcttcaaatatgtccgaattgcggtttcaaaaaaatagagctttttcggcatacggatattggcatccagatagcggtggttgaccccctttatttcgaccgtaaatttcttctcccctctttgaatctcgcaccggccaaagcccgtcatacttctaatcatggtatcttcctctatatgtttattttgctggttttcattataattcatttaatttttatcgtcaactatgttatactgtaaaataaaatgaaaaaacaacgattctgccatgcggatcagattcgcatgacgactgaatggttggcaaaaaaggagaatacctatggcattagatggaattaccattgcaaatattgtaactgaactgcgctcctctctccttggagggcggatcgcgaagatcgcgcagccggaggcagatgagctcctcctcaccatcaagacgtccggaggtcaaaaaagactctacgcatccgccagtgcttcccttccccttgtctatctgaccggagagaataaaccgagcccttttactgctccaaacttttgtatgctgcttcgcaagcatattgcaaatggacgaattatttctattatacaaccgtcactggagcggatcattgtcctggagatcgagcatttggatgagcttggagatctctgccgtaagaagctgattctggaaatcatgggaaaacacagcaacatcatcttctgtgatgcgaacaaccggatccttgacagtatcaaacatgttccggcacagatgagttccgtgcgcgaggttctcccgggacggacgtatttcattccggacacgatgcataaagccgacccactgactgtcagtgaagatgattttgcggcactgttaacagaaaaaccgaccgcactttcaaaggctctctatacgagtatgaccggaatcagcccggtagcagcgcaagagatctgctatctggcaggtctcgattctgatttgccgccatctgagctatctgaagacctgatgacccacctgtaccgacagttcacgctgttcctcgatcaggtgcgccaggaagattttcatcctgcaatatataatcggaacaatgagccttatgaattttcttccgtccctctcactcatctgaccgggtgttcccatcaagactacagaacgatttcggaagtgctctcctcctactatgcggtgaaaaaccggatcacccggattcgccagaagtctgcggatcttcggcacattgttcagaccgcattggagaggaaccgaaaaaaatatgatctccaggcccgccagcttcaggatacacaaaagcgtgagacctacaaggtctacggtgaacttctccagacctacggctatcaggcagatccggaatccaaagaattagaggcactcaattattatacgaatgagatgatccggatccctctggatcctacaaaaacacctctggaaaactccaagcggtatttcgaaaaatataataagctgaaacggacatacgaagctctttcccgtctcatagtggaaacgaaggatgaaatcatctatctcgagtccatcagcaacgctctggatatcgcccgtaccgaagacgatctggcagaggtaaaagaagaactgactcagagcggctacgttcgccggaagttcacgaagaaaaaggaaacatttaaaagcctccctcttcattatcgttccagcgacggttacgatatctatgtagggaaaaacaatttccaaaacgaggagctgaccttttctttcgcgtctgggaacgactggtggttccacgcaaaaaaagtgcccggatcccatgtaattgtcaagtccaacggggaagagcttccggaccgggtctttgaagaagccggaaagcttgctgctttttattccaaaaataatggaagtccaaaagtagaggtggactatgtggagaaaaagcacgtcaaaaaagtgaaaggccagaagccgggatttgtcatttaccatacaaactactccctgattgctgacaccgatatcagcatgttgcaggaaatatcggaatcctgaccggaaacgttcaaaaaggaatcaaaaggtcctgcggctaaacgccgcaggaccttttctaaatcctatttctataacgaacggataaagcgctggaatgaagctcttccctcttccgtgcacttgtaaacccctgcgtcttccaggacatgcacaaagacttttccgatttcctgctgtaagatttcttcgatgtttgcttcgttgacttccggataggacggaaggaaagtttctacccagtccgcatgtttttcgatcttttcgttgcttcggacgtccttgcctgtcaggatgtactcttttaaaagctccatctcttctttcaggcgggccggcagcacggcaagtcccatgacctcgatcagtccgatgttttctttcttgatatgatggtactgcacatgtggatgataaacgccaagcggatgttccggagtcgtaatattgttcctgagcgtcagatccagttcatatatgccatccctcattctggcaatgggtgtaatcgtattgtgcggctctccatctgtctcggcaaagataaacgcctcttcatccgtgtatcctctccaaactttcagcacatgatccgcaagatcgatcagccgtttttcgtctttatggcggattcgcaacacggacagaggccatttcacaattcctgcctccacatcctcatagcccggaattgtcacttccctttcgatcggagcctttgccatggcgaaggtataatgtcctccctgaaaatggtcgtggctcaaaatggagcctcctacgatcggaagatccgcattggatccgaggaaataatgcgggaactgtttcacaaaatcaaagagctttacaaaggcaggccggtcaattttcatcgggatgtgttctccgttgaatacaatacagtgttcattgtaataaacatacggtgagtactggaatccccattttgttccattgatcgtaagtggaataatccggtgattctctctggccggatgatccagtctcccggcatacccttcattttccaagcagagctgacattttggatatgctgttgcctttgcgttctttgccgccgcaatggctttcggatctttctccggcttggataaattgatcgtaatatcaatcgttccatacggactttccactgtccatttcttatccttttttacccggtagcgacgaatataatcgctgtcctgactgagtttataaaaatatttcgtcgctgtctccggggatgtttcataggcctcccagaattctctctgcacctgagcaggacggggtacaagacagttcatcaccttggtatcaaaaagatctctgtaagcaatactgtcctcaatcagtcctcttttcactgcctcatctaataaatctgccagtacgttttccagatccacatgctcctttgtttgttccggctccacgtagctttcctcacaaaacagatccaaaagcaagtttgtcgcgtaaatcttctcacactccgggagcagtccggtctcgatcccatattttatcagtttgctgatagattcatttaacattttttcttccttctttcctataatcttcttgcgccgtcaccgatctctaccacatagaattccgcctcatgtcctgtctgctctttgtaaccttttccaacctgctcgacaaacgtctctaccgcgtcatttttcacaatgctgacggtacatcctccaaatcctcctcctgtaatccgggagccgaccacaccattgatcttccacgcaagatctaccagaatgtcgatctcttcacacgacacttcataatcgtcccgcagagagatgtgggactgattcatcagacgtccgaacccggcaatatcattctcctttaacgccttcacagcacgaatcgttctctggttctcgtaaaccgcatgtttcgcacgcttcttgcagatttcatctccaatagcgtccttatgaatttcaaactcctcttccgtcagatctccgagtgtcctgatatccactactttctgaagatccttaagcgctgtctcactttctcttcttctgtcgttgtaagcagaatccacaagactatgttttaccttgctgtttgtaataacaatcttagcatcctcaagcttcacagtcgcatactcatattgaagcgtattcgtatcaaggaataccgcacagtcttttttccccatagctacagcaaactgatccatgataccacagttgcatccgttataatgattctcagaatattgtccaatcagggcgatgtcctgcatggaaatttcaatatcaaataaatctttcaaaatcacgcctgtcaatacttccaaagaagccgaagaagaaagtccagatccgtttggaatattaccatagaccagcacatccatcccctgggcaatagaatatcccttcttttcaaacgcccagatgacaccctttggatagttggtccactttgcagccggagacggtacgagatcgtcaaggcttgtctccatgacgcccaaaccgctaaaattgtcggaatagaaacgaatctttctgtcgtttcgctttcttgcaattccataagtaccaagagtcagcgcacacgggaagacatggccgccattgtagtctgtgtgctctccaatcagattgactcttcccggcgaaaagaaggtccgtatatccccctctcctccatacagcttttgaaatgtctccattagtttcttttccatacttcattacctgctttctctttgttttctgattgattttctttaagtaaaattataatgcgttttccaaaacataacaacaaggatattgctcaaaactataacgatattgagtttttgtaggttgattttctccggataccagcgtatgatacaaaggaagaaaacgaagttctttcttcttgatgaaacaaaacatattttcggaatttccgggcaaaccggagcggattgtaattggagtttgacaaatcatgcagatacagattaacgaagaaaaaaaggaattaaaacaacacggggattacacatttccggttcatctaagtggtgaaatgctttcccgctatgagggaggctcttttttctggcactggcacacagaggtggagctgactctgattttaaaagggcagatcgaataccgggtcaatgagcgcacctatcatctcaaggcaggggaggggcttttttgcaacagcaacgccatgcatgccggaaaacggatcgataatcaggactgccaatacttttccgtcacctttcacccccgctttctctatggatttgaaagcagtattctccagacaaaatacgtggatcctatcctgaatacgtcctctttctcctccgccgccctccttccctcagaaaactggggtgcaaaagtcgtgccgcttttagaagagatcttcggtctctaccatacgccatctccggaccaggagctgcggcttcatatcttgctctcggaaatctggaggctactgtacggccactttacaagctgttcctttaaagagcctgccttctctgattccatcggccgcctgaaagacattctctctttcatccaggcctcctatgccaaatctattaccctggcggagatcgcagactatgttcatctttctaagagtgaatgctgccgctttttcaaacggcatatgaatatgaccttgtttgattatctgttatattatcggattcagcaaagtcttcccttgctgcgggagggattatgtaccatttccaaagccgcggaatcgtgcggattttccaacgtctgctattacggaaagctattcaaacgctatatgaactgtactcccagacagtatcagtcccggttccgctcctaatgagcgtaccgggacttttttggctttccttgattgctctttccttgcgtcagtccagactgatcgcatctattcttgcaagctcttcgtccgtaaacggcgtccggctgattttggtggcattttccacaagctgggatgggcaggacgctccgacaaggacactggtcacctcatgatcttttaacacccagttcaacgccatctgagaaagagtctgccctctcttttcggctacatcctgtaagccgcggatcttcgccatcctctcttttgtcagtgcgttttcattcaggaaacgtccgtccgtgcggattctgctgtcagccgggatgccattgagataccgatccgtcagcatcccttgcgccagcggactgtacgcgatgatgccttttcccaggctctttgctgcctctttcagtccgttttcttcgatcgaacgatcaaagatcgagtagcggttctggttaatgacaaacgggcagtgggcttcctccagaatctccgccgccctccgcatcgtttctccatcatagttggaaatgcccacatacagtgccttaccgctcttcacgatcgaaaccaacgctcccatggactcgtcaagcggcgtatccggatccatgcagtgatgatagaatatatccacataatctaaccccatccgcttcaggctctgatctaggctggcgaccagatacttcctgcttcccccagatccatacggaccatcccacatatcgtaacccgctttggtgctgatgatcatttcatcccggtatggtgaaagttcccgcttcaaaatccgcccgaaattctcctctgcacttcccggaaccgggccgtaattatttgccagatcaaaatgggtaatccctaggtcaaaggcagcaaagcacaactctttcatggtgtcatacgccgcgttgcttccaaaattgtgccacagtccaaaagaaacggctggcagtttcagcccgctttttccacaatttgtataactcatctgctgatatctcttctctgaagcctgatacatgattctcctccttaattccctctctctttgatagtaccggaccggtatgctccgatcagttcttttaactccgcaatcttctttaagagctgctttccattatctgtatcccccaccgtctttcttttctgattgtaactgactgcaatttggtgggatacaatatctgtctcttcctggatcgcgatctcggtcgtctcaaacggttcatgcgccgcaagagacataccataggaattataaatcagcgtatatccagcgattcctgtctcccgatgatacggtctggaaaatccgccatcgataatcagaacttttccttcacatttgaccgggctttccccctctttttgatgaatcggaacatgaccgttgataatacgtgggctgtcgccttccaggccaaattctttcagaatcagctccgccgtctcttttctttccagcaacgtataataagcatttttcacctcccggtgagtctccttatcttcgatcagatatcgttcaaaggtagccatctgacttctgccatagagcggggatcccggagccgaccagagaaaccagagaatatgtttgccacgttctttttcctgatcttccatagagaaaaacgccttccgcacatactgctccaatacgtcatacagctctttcccctgataatatgtcccatagacagggacttccatcagtgtcacatccccgttcatcggcatacagccgtgatagagcagattgccattataaactttgtaaaggcttccctgcttaagcagaaacttcacatgcttttgcagtttctcacagtttttaaaggcacgtgtcagccgttccattacgttttgttctttctctgtcaaagcgtatggatctgacggatctatcgtcggaaatatagtatccagaagtgcatactgcttttgcccgatcttcacctgcatcgtatcataatcgatccgctctaacagccttcgcccgtccataccgaactctggattctccatggcgagcttcccctcgattttaaactggatcacagaaatcgctttgtgcatacgctgctgaagcgccagcgaaatatctgctttctcctccggcgtcttaattgcaaaccgcgccgcgtcatcgtcaccgtaagtctccagggcaaaggtcacaaggggcagcatgttgataccgtatccgtcctccaggatatccagattgccataccgcaggcagaggcggatcactgtagcgatacacgcctgctgtccggcagcagcccccatccagagcacgtcgtgattgccccactggatatccagagaatgataatccatcagacagtccatgatccggtgcggctgcggtccccggtcaaaaatatctccaataatatgtaaatgatccaccacgaggcgctggatcagctctgccatagcgatgataaacggctctgcccgtccgatatccagaatcgtctggataattgcctcatagtaagcttccttgtcagagagctccggcttttccgtgatgagctcttcgatcacataggcataatcctgcggcaatgcctttctgaccttggatcttgtgtacttggacgacactaccctgcaaagctcgatgagacggtaaagcgtcacccgataccagttctgcatatcctccccggactgacgaagctgctctaatttttctcttggataataaatcagagtcgccacggatcgcttctctgccgtccccagcgtatgtccgaatacatcgtcaatcttcttacgcacagcaccggatccatttttcagcacatgggaaaatgcctcatattccccgtgtatatcggaaaggaaatgctccgtacctttcggcaggttgatgatcgactggaggttaatgatctctgtggacgctttctcaatagtcggatataattccgccagatactccagatatttattttgttccatgatttcctccttttagttcggattagaacgcagacgaatctctggggctttcttttcaacgtatacacacacctcacagatcttcgcactcctccgcatgattaggatgattatatcatacttttggatgtttgcgggagaatagatatacaactgacaatcacgttcccaaaagaaaccgctcacgactttcccttggaactgatttttctgttagatatcatttctgtattcttatcatttttctttatagaagaatgattccacaggcaaatccaaacctctcttggtgagcgagcgccatcctttgtaaggatgtcttcaaagtcccctgcttaccaaacagattctccattgcctgttccgcataatgacatgtcccgatcacataaaacggatcagcaaactgccgaatacgagagtcagcaggaagatgccgtatcatatccggatacaacaaccaactgtaacagagaatagctcgaaatccagcatccggaaatatttctgaaaagaattgcttggcgctctgaatagatatctctacgttttctctgcttaggtccgctcctcttggaatatgacaattcaacacccgactaccaggaggaagcatttcttttgcgttctctatatagataaaatcaaaaccatccatcggctcttccacatacatcatctcaaacggctgaaattgcagagatcctatctgaaatatttccgtttccatgatatgacgaaaccaaaccacatcatcctgatccagaccaacttctccgattttctgaaaatacagctctgcccttaacgctacatcccgaaaggtatcccatatcatattttccggaactcctatcttctgatattttttatattgttcacacagtaagtagatcactacagccagtcgcatagctggtctctgactacacaactcgaaatcaaaattttctcctttataggcagtaagggaacggagttctatttctctctgatggtaagcaaattctttcaaaagtgccttttcaatacaggcagtaaattgtaattgtgttactatagtatcaaaattcatcccacactctctacagtcccatctcttccatccactttttcacctgtgcctcggacacagaagcgttcatcttcctccctgcaagcacgtttgccgccggacataccttttgcagaatctcacttgttttccccataccgctgccaccggacgttgcgaatgggacaatgattttgcccgtaaaatcatattcctccaaaaacgtatgaatgatgcggggagcttcataccaccagatcggaaatcctacaaataccgtatcgtattgatccatgtgatccacatgctctgcgattgccggacgggatgacggatcgttcatttccagagtagaacggctttttttgtccgtccagtccagatcctcacttgtatacttctgtaccggttcaatttcaaacagatccgctcctgccgcctctgccactgtttttgcaagtctctgagttactccgcttgcgctgaaatatgctactaatgcttttttcatatcttacactcctctactttatcatctctaattgatctttcatccttgttataatccggatcttcatcgctgtacgccccagataaaacaaacttatacagatctccacctgaccgttctgccgtatatgccgcaatagactttgtattgcttgtcatagaaaaatatgatataagaaccctcccgtcttgcggcgcctctgtccaggatattccctcattcatctatctccagtaacttcttggccgctgaaagagtcatgtcataaatggaaaaacagtgaactgggactcctgccgcctccatagctgccttttgctttggtgttattgaagaataagggtaaatcccatacacaaaagggaaaaacgcatagagaaattttataccgtcttcttctgacagttccggtatgcagcggctggcacattccgccgtcagatttaacgattccccatacacctgtttaaagtctatcagtttctcaatgctgctattctcttcaatatcatacatattcatggagagaagtttcagcatcagttcccgtttggacaaggtctcggccagcagaatagcaaaatccatacggctcatagacgtcttcttccgtagagcgctccttaagtcaatgttccagtgctcatattccctctgtagcaaagcaagaaaaatctcctctttcgtctgaaaataattatagatcgaagttcttgtaaacgatgtggtttttccgatttccttgatggtaatctccttaaagctcattgttctatagagtttcttacaggcgtctataatttcgttttcccgctctttcgtcagttcttccgatccttttggcataatctactccttttattctgacaccgtgtcactatatacaatatagcactattctgacacgatgtcaacacatgccgcatatcataatggagatttggtgatattttaatagtctctctacatttcctgtggtaaaatcatagtaatcacttaatagacttctccggacaggatgtggaagcgttatattccctttatcgtaatgcaggaatcgaatttctgaaaggccatgctcccaaacccaagctgtcaggaagaatgataaggaggaatcctatgcaatacattagtcattattcatctcctctcggaaatattttgctggcggcagatgagactggcctgaccggattatggtttgaagggcaaaaatattttgccctctatcttgataaggtgtataaggaaaaagaactgcctgtactgaaacggacgaaacaatggctggatctgtatttttccgggaaagaaccggatttcacagtaccatttcattttacaggaacgaattttcaaaatgaagtgtgggaaattctctgtacaattccctatggaaagaccgtgacctacgggcagatcgcaaaacagatctctgaaaagtatggcaaaaagcaaatgtctgcccaagctgtaggtcaggctgtgggacacaataaaatctccattttggttccttgccatcgtgtagtcggaagcgacggcagtctgaccggatatgcgagaggtatagaaaaaaagcagctttgctgactctggaaaaagcagatctgcacagagataggtagcggcaccaaagaggagtttagactctatctgtcagacgtcaagatctgctttaacccaagctgaatacggatgaccgggcagaagtgaggtgacttgcttctgctttttctcaaccactcacctcgaaactaccacgatacattccgtatgctcagtatgcggaaataaatctaccggctggatcatctgtactctccacccttttttcttcaaaaactccagatcccgtttctgtgtctttgggttacaggaaatgtaaatgagcttctccggattcatccggctgacagcgtcaagaaattccggtgtgcttcctgtccgcggcggatccagaaagaccacatccacccgttctcctcttgccacaatcttacggattgcttttgtcgcatcctcgtttagaaagtgcgcgttgtggatcctgttatctctggtattctggatcgcgcaccggatggcgcttccattcttttctacacccaaaacactttttgcataggctgccgccgcaagtccgattgttccgactccacagtatgcatccagaactgtctgcgttccattgagaccagcagcctcgatcgccgtccggtaaagaatctccgtctgcaccgggttaatctgataaaaactagaagccgcaatccgaaaccggattccgcaaagttcatccacaatataaccttttccgtacagaatcttttccgaaaagccaagcacggcgctagtggatctgttattaatattctgcacgatcgtaccgactttcggacagaattccctcaccttctttacaaatgttttcgctcccggaaggaaaggtgacgctgtgaccaatacaatcagtacttcatccgtcagaagactgtgccttaccaggacatggcgtaaaagtcctgtctttctatcctcatcgtaaggacgatacttacatagtctcgccgctttccggaccgcccgaaccgcctcatcaagtcttgggtgatgcagcaggcaagtgtgaacgggaaggacataatgagtaccacgggcatagatcccactgatcaactcacgccccggtccttccgcaaaggttgaaattgccttattccggtactgccaaggatactccatcccaatcaccggacgcactttcccaaaattccccatcagttttttcatttccttttgtttcatatgaatctgctcttcataaggaatggaaaggagcggacatcctccacatcctttttcctgtaaatgacatctgttttcctgtctatccatgttccacctcttcttccgttctctttccttattttatcataaaacacgccacaaaacagcaaaaaaagcttcgacagcaccgacggtctatcccctttactctcagtccgttcctactgccaaaagcttttctcacgttttctatcgctggtagatgcactctccgttcatatataatgcttccactttcacctgatcgatctcttccttaggaatagtaaacaggttccggtccaaaatggcaaaatgcgccttataccccttcttcaactgtccgattctccgaaatcccgccgcttttgcggattcccttgtgtacagtttcactgccgtctccacatccactttctgatcctgcccgcagtccgtaccgtcatacgccttccttgtgacagcagcctttaaacatgggaacgggtcgtatggaaccgcccaggatgtggcgggagcgtctgtagaaaaacagagcttcacaccctgattgagtatcgtcctaaccggatagcactgtttcatccaggtttctcccagatttttcagatagctttcaatctctgcataaaggaaaatcggctgcatcacaaagaaaatgcctttctccaccgctttgcgaatactctcccatggcggatcagtcagatgttccaaacggacatacggagtatcatccagcatccagttttcctcccggtatgctcgttccacggctcttgtgatggcctgtccacccatagcatgcatggaaagctggcaatgatattgcttgcaaaaagcaacagccgattccatcagagtatccgaacaggtggaaatcccgtattccctgtcagtgtcaagatatggcttatccatccatgccgttcgccctgacacacttccatctccgatcagtttcaatcctgccacaaacacctgtccgtttttattgcggcgctcttttggaatcctaaacttcggatcatcagcaaaatagtcccacatataatagatagcggtttcctgttgatatccatgccgtatcgcttcttgatacagtgaaaaattgtccccggtgtccagattgcccatatcacatacagccactattccctgagatttcaaccgattgccaagatccaccaagttctgcactttttcctcgtaagtctcctttgggataaacggaagcacaagatctcttgcggtttctttgagcactccggtcggttctcccgatgcatctcgttcgatctcaccgcccaccggatccggcgtatttcgtgtgatcccggcaagctccaacgccctgctgttgacacagcgaatatgtccgcacgtccttgtaatggaaaccggggcgccggcactgctctcatccaaatcatagcggtttaaagaacgcttctcctcaaactttccttcatcatatccccatccttcgatccattccccggcttttttagtcttgcggacttgccggattcgctcttttaattcttcaatcgaatggacttccggtggaagtgcagaaatctttttgctgaaatctgccagcataaccgggtgcatatgtgcgtctataaaaccaggaaccacacaggctccctttagattcacacgctcatagtctccctccgcaatagcttcccgtttcccaatccactgaatcgttccgtcagagacaagcatggcatctgcataaaggtttgtgtcgtcggatgtaaaaatcattccattttcaaataaacagtctttcatctcttttcctcctgccccttattcattcagtataaggtcttccattttttcttgcaagcaggataaagaagaatttttattatttacggtattagtcgaagatggtttatgccgccgaatgacctctttgactacctttctggcaggctgcggcaaattcacgaagcttttgctctgcttccggtgtcagtgtatccggcacctgaatctgaactgtcacatactggtctccatgtacggaaggttgattcatccgggcgacccccttgcctctcaatcggattttcgagccggactgtgtcccttttcggattttacaaagtacgcgccctgtcagtgtctccaccattacttctcctccaagtgccgctgttgcaaatgggatctgaaccgtcgtatagagatcggcaccttttctctcgaatccaggtcttgcgccgacatgtattttcataaacagatctccaggctgaccgcctcctgctcctggcataccctttcccttaagccggatgctttttccatcctctatcccctcagggatgtgtacttccagtgtctgcgtcgtgccgtctcctctttggatccggattttcttgtcacagccaaaagctgcctcctcaaagcttattgatacatcggtatgaagatcctctcccttggtctgatgagaccgcccccgaaatccgctctttgtatatcctccggacccaaaattctgtcctccaaagctgcctctgtggtggaaaaattcaccaaagagatcgccaaacatatcatccatgttgccgccttcaaaacggtattcccggtattcgccatcttgtcggctatcatcgtgaaacctgccaaagccaccgaatcctccaaagccctgcccggttccctgcgctccctgagcactctgatcaaaagctgcttgaccaaactggtcatacagtttcttctttttaggatcactcaacacatcgtaagcttccgtcacctctttgaatttcttctctgcatccgcatttccctgatttgtatctggatgatatttcttcgccagttttctgtacgcttttttaattgctgctgcatctgcgtttctgctaataccaagtacgtcgtaatagtctctttttgccgccatactgttcaccctctcttccatcgattctgatttctattactttgaaaataccccggagcaatccggggcacatcgtcgtctgttctatttataatataacaactgtattttccaaagtcaatagggtgactacattttataaaaaatatcctgatggtttcaggatttctaccatctggctgtctgtaatcaaaaaagtctgacatggatttcccccgatgacagacggtcagtgctgccatcctcatattgaacaagaaggtgacaatcctcatccactccggtagctactgcttttcgctcaccttttggcgaaaatatgataatctctcttcctactaccagacttcgtctgcggtactcttcctcataatcttcccgtttgattccttgataaatactcagaaaccggttcaaaaattcagccgccagatggttttttccatcattttgtttcttgtcaaaaatcgcgcctgcactctcccggatctcttccgggaagccctcctccggtacatagatattcattccaatcccaagaatcacatattcaacactgcccgtctccatactgacggacgcctctgtgagtatgccgctgattttccggtcatccagatagatatcgttcacccacttgatctgcgcccgtctgttcgataccagttccactgcctcgcaggccgccacagccgctatggtggtaatctttgacgcctgagtgggctccgcctgctcaggccgcaataaaatgctcagataaatgccggtgtctgccggagaatgaaagcttcgaccaaatcttcctctgccttttgtttgtaaattagcgatcacaacacttccttccggttttccagcatccgcccattcccgaagcagtccgtttgtggattccacttccggaagtacattcaaattcagaaaaccgcataaaggaatcagatatttccggatcccctgtgcggaaagaatatctgtctccgtcgaaagacagtaacctttattggagactgccgtaatctcatagccatccttacgaagactgttgaccgctttccacacagccgcccttgaaacagacaacttcgccgcaatctcctctccggaaaaaaagacacccttatgctcttcaaacaaagccaggatactttctctggtactcacgttttcacctccttttcttcttgttgctggatatcgagtctcatctacgttccagatatcagtttatatactctgattttcccatcttctcttcaaaagcacgatgctttcgacatgtacggtaccagggaacaaatcgacgcatccggcccgctccggcacataccctctacctttcaaaagctccagatcccgggcaagactggtcggtttacaggagatatagaggattttctccgccccaaatccaatgattttctcaagcgccttcggatgtacgccatccctcggtggatcaaggataatgagatccggtacctcattcagctcatccactactttcagtacgtctcccgcccagaagttacagttgtcaagcttatttaacgccgcattttctctcgccgcttccacggcttctttcacgatctccacaccgactaccttttttgccaccgacgccgcaatctgggcgatggttcccgttccactgtacaagtcgaacacgactttgttttttgtatctccgatataatctctcgcagtctcatagagcacctccgcccccaatgagttcgtttggaaaaaagaaaacggtgtgatcttgaatttcaggcctagaagctcttcgtaaaagtagttttccccgtaaagtgtagttgttccttcatctttcacggcatccgccagactgtcgtttctcgtatgtagaatcccggcaaaggttcctttaagcggaagattaagcagtgccttcttccatccttccagaagcgtctcctccccgatataggaactggtcgtaatcagatctgccaggatctcccctgtctttaccgctttccggacaagcaagtgtcgaagatacccttcatggtgcatccggtgataaaatgggacttcctgctttgcgaagaacgccaaagtacaatccagaattttccgaaaatcctcatccacaatccggcaccccgataccgtcacgatatcgtggaaatttccccgcttgtgcattccaagggcgagcggcccgtctttgtattcatctccaaaggtaaactccatcttatttcggtaagcctcccgcaccggactttctttgatcccctcaaagatctcgtccggaatccggtcttttaacagatcccggacctgattttcctttaattccaactgtttttcgtatggaagactctggtatgcacagcctccacacatcccgaaatgcggacatggggatttcatttcctccggcgatgcttccagcacctccaagatgcggccttcggctttcccttttctgaccttattgaccaaaattttcactttctgtccgggaatggcgtattttacactaacttcctgctctccattctccacgcttacgactcctttattggggaatttcacgcagcggacaataccctcatagatcgttccttttttcatactttctttctcctatcaattctcaaaaaaataaggcaggaagctgctttcctaccctatcttctctttctttttctgtcattattctacttcatcttcatcatcgaagaagtcgtcatcaaagtcatcgtcaaaatcttcttcaaagtcttccagataatccggtgtaaagaatgagtatacggcataagcaatcgccgcgacagccgcaacggctccgataatagccagtacccaaacaatcacctttttcgtatgatcttcatcttttttctgtaataattcgcttaatttggaagctgccataatctcttcgaattttccgctcatgctccctctcctttctgatgttgccatctcaacgcttattctttttcgtaattataccactatcataaacagaataccatctttttatgtgaagttttcctgtttttgtcagaatcccgactcatccattttctgtagtttggcaaatgcggcaaacatctttttcacaccaaaccggtcaaactccactgtcacttcgtaatcgcgaccaccttccgtaattgcggtgacaagtccctctccaaatttcatgtgccgaacacggtctcccacatcatagcccgggccttctccggaagcgaccttaaactgctgaaccggccttttaatcccaaatgcctgggaatgaaaagctgcctttgccttagcataagtctggttacgggcaatctccatctgcggccgttcccgcaaagtccctgatacagttccaataaggctctctggtatttcctttaaaaatcgggacgctatattgtactgtgtttctccgcggaccatccgacgcttggcacaggtcaatgtcagctctttcatggcacgtgtgatccccacatagcaaagccgtctctcctcctccaactccatcgggtcatccgccgtaatcgtcatataacttgggaagaggccgtcctccatccctgccaaaaagacatacgaaaattccagtcccttggcactatgcaatgtcataagcaccacataatcgctctcttcgtccagattatcgatatctgccaccagcgccacttcttccagaaatcccgaaagtgtcggctgctctccggcctcttcacagctctcctcgtaagaagcgagcttactctttaattcttcgatattctcaatccggctctcggcatcctccatatcgatctcttctaagtaattttcataatccaatgtctcaatgatatctgtaaggagggcaaggggcgtcagccgtcctgcctcttccttaaaatgctcaatcaatgccacaaaggattccaattttgaaagggcacgtccgatccctggaatcagatccgctgccagaagtgcctcgtaaaaccccgtttctttttgcagggcatattcttgtacccggttgatggaagtcagaccgatcccacgttttggcacattgataatccggcgcaccgccagatcatcccgcccattttctatggtacgaagataagccaacagatccttgatctcccttctggcataaaagttcactccgcctatcaccttatacggaatgttcgtggagacaaagcgctcctcaaacatacgggactgtgcgttagttcgatagagaacagcacaatccttgtaggaagccctctcctccttgacctttttctggatcgctgccgcaatataatccgcctcgtcatatgcattatcaaactgcttacaggcaatcttttccccctccggattttctgtccagagtgtcttgtccttcctccctatattgttatgaatcaccgcattggccgcattcagaatattggaagtagaacgataattctgctccaatttgatgaccgtcgcatctggaaactcactttcaaaattcagaatattcttaatattggctccccggaacttgtagatggactggtcgtcgtcccccacgacacacagattccgatacttggaagacagaatccggatcaaatggaactgtactgtattcgtgtcctgatactcgtccaccataatatagcgaaaccgctcctggtagtaatccagcacatccggctgagtctcaaacagttgtactgtccgcaccagaaggtcatcaaaatccagagcattgttcgcccgaagttgcttttcgtattccagatatacttcagcaatcttctgtttggagaaatcaccctccgcctgcaataaaaactcctgcggactgatcatctcgttcttcgccgaggagatggcgctgagaagtgcacgttcccggtaggtcttggtgtcaatctgcaggtacttgcagacttccttcatcaaagacttctgatcgtctgtatcgtaaatcgtaaaattcgtatcgtatccaagccggtcgataaaacgcctcaaaatccgtacgcaggctgaatgaaatgtactcacccagatactctccgaaccgaatccaaccagatggtccaccctctctctcatctcacccgccgccttatttgtaaatgtgatcgcaagaatattccacgggttcacccccttctcttcaatcagatacgcaattcggtgagtcagcactctcgtctttcccgatcctgctcctgccagaatcaggaccggtccctccgtctgaaagaccgctttcttttgcatctcatttaaggaatcgtaaatactcattgtcttggtactcccatctctgctcgtagtttactcagtataccacacatttgttcggtatttcaagagattggaagattcttcttccgcccatttttacaaatagcttgccatctagttttgaaaactatataatgtatctataaagttttgttatgaggggttgtgcatatgacgattgataccaatgatttactgaacagtattttacaaagccttgagcggatcgattatattcatcctgaagagattccgaatatcgacctttatatggatcaggtcactacgtttatggagacacaattaagatctactaagcgttacgagcaggacaagattctcacgaaaacgatgattaacaattacgccaagaatcatctgctcccacctccggtgaagaaaaagtattccaaagaacatcttttggtgctgatctttatctactattttaaaaacctgctctccatccacgatattgagaccctgttaaagccactgacggacacatatttccagacaagcgataatttcgacctgtctgcggtctacaaagaagtctgtcacctggaaaagagccgcatctcctcagtacaggaggatattaaaaagctctggaatgaatcttccaaaagctatcaggatgcgccgtctgaagatcaggaatatttgaagctttttgctttcatctgttctttaagctttgatgtatatattaaaaagaccattatcgagaagatgatcgattcttttgctgagaagacgaacgacaaataacgggaacatagcaggacacaaagtaagacgctgatgtcatcaaagcatcagcgtctttatgattactctttgttttcaattctgtcaaataccatatcgtatccgtcatttccgtagttcagagaacggttcacacggctgatcgtcgcggtagaagcgcccgtcttctccgcaatctccagatatgtcttctgctcgcgcagcattttcgccacctcaaaccgctgagacaaagataaaagctcattgatcgtacagatatcttcaaagaagatgtaacactcctctttgctcttcaggcttagaatcccttcaaatagattgtccacagcctctgtcttaattttcctactcatatctaccctccatatcgtgttcgtcgggcattctttctgccagctactattttaacacactaaactcataaagtccagtacttgttaacctttctgtctgatcagacgggaaaacttctcataagacgttgtggcaatcagctcttctgggaaatcggcctcctgaatgagcttttcgatgcagctaaatccaccaacatcgatatcaatgtgagcgtcgcttcctgttgtgatatagacgccttcttttttgcagagctccaacattacttttgcgttttcctctgtattgacccggaatccttccggtctctgagaggaattattcagctccaagagagtgtgcgtctcctttgcccctctcaccagcctttcataatctaccggaaaacgtccgtcgtccggatgcccaataatatggatgtacggattcttcatcacattcaggtacgcctgggtattcaaatcccgactccctttttcgataatttcggaattcgtactataacaaggtccgtggatacttgcaatggcaagatccaaggactgtaatacaaagtccggaagatctactgttccgagttcatccagaatattaagctccgcgcccatgaaaatgtgcagtccgtccactgtccttggtaccaccggataattctgaaagtaaaattcatggcatgttcccggcatcttcggtgcgtgttctgtcaaagcgagtgcctctaatccttttgttttggccgcctgaatcatctccatcctcgtactgtaagcatgtccacttacaatcgtatgagagtgtgaatccactaaatatttcaaaaaagatcccttctttcttttcactttcctgctttagtttaacatattttgccacttagaacaacaatacataattcttttgattctgtccatactctttgttgaggtgatccacatggaaaagaattctgtttcaaagaaaaaccggcaggtcatcgattcctacgattacctgggaaattctgcctctgcaaatgactgtaccggactcattccgtccgctccgcagtcagaggcagaacttcagtcctatgaagatgtctatgcatttacctctcctaaaatcagggcgaaaaaggaacaaaaggattcctgacaaagaagccattttgcagggacactgcaaaatggctttcttttcgatacgattctctataatatgctaaaatagtgtcatctgtccggtacagtatcgcacctgcttggccatccgaacctcgtcttccggccgcagacgcccaatcagaagcggagattccggatcatgctccctcatattctgccgtaccagttccctattttcattcgcatagcagtaaatacaaccatgaccgcatgtattatacgctccaatatcgctgccaagaagacacccacagccatcccgctgcgtcttcttccctgccggaacccgaatctccattccgatagcgtgttccagaatttccctcgtcatgcatccggagacatcgatcccgaactgacaaagatgagtcccctcgcagcaggaacgaatccggattccatagcttgcccctattcttgcaaactccctgccgatttcaagccgctcactttccggaacgttacacacacctgggaaattccgctttgtcttctcataaagatcaataaaactaatcacacactgatccacatatccacacaacgcctcacacatcttctcaaatgctgctatgtgaaaagaaacgctgtacttctcggacagaaagaccgggtcataccgccagcttaccgcctgccgtccaagggcgtctgacaaggttcgaagtgacgcgatcacgactctcttatccggaacatgtggctcaatctctttcccgtatggggtaatcgtaacaaaccagaattgatgaaaattccgcaactcctcaagatgccccagcatcggctgtggattctttgtacaaaaggccagacagtccaccacgtcaggagtcagccgaaatcgtgtaacctgccggggaaagtacggattcctgaccagaacatatttttcccgaatccgtcgaatcagccatttactgtagtatgccgggatatcggttctcattccggtgtttacaatcacttacaccacactcccttcccttttacgactacttctgtcttttcctcatccgattaggacagtgtaaatgcctcctctgtgcctgtcgtgtcaatgagggctgtcacaagggcatcaatatcctctgacgggatctcccacacattatcctttttactttcctgaacatggactgtgatcatcgatttttcgccgtactgcggatcctccagcacttgactcagacactcgtaaagcatttcccctgctgcctctgtcatctcctcatccgtcggcgccgcctgattgttcaggatctgctcctgcaccttggcaatgtactcctgaagcttttgctttaattcctcttccacaccaccaatcatcttcactggctccacttcaacgcccacctcaaagtttccatcttcctgctcctttgcttcctgaatagtgtacttcgtcttcttcatcagatccggaatataggaccggaacttttctgtcagctcgtccgaaaatccgagggaatcaaactcctgcatataagaactgatcacagcttcatactgctgccttgcctcctcctcgctggtatcagcgaacccctcatacgcctccgtctctcctcgtgtaatcaaatccagaacagcctgtgtatatccggtagcatcaaatggcttctgacatcctgtcagcactacaactgctgtcgccactagcaaaacaacgacgtttcttacatactttctcattactctctcctttctgcttttactcagtataacatattttagaaatcctgtcatccgcacaatcaggaacaagacagcggcatacatcaagcaccgggagcactaaaagacatattacggaatggtaagtcgtcgccaagttccttggcaagtccggactttggcgcatcgcacgctacaaaaaaggctgcctgttgcgggcagccttttttgtaatcctattctatggcttttaaatatctaaattaatcaatgaatttatataaataaaaggtacatacaatttcgattataatctggtcacattgacagcctgagggcctttttcgccttctgttacttcaaattcaacagcctgcccttcatccagggtcttaaatccatccatattcagtccggtgtagtgtacaaaaacatcttttccggattcatcgctgataaacccataccccttttgattgttgaaccacttcacagtacccttgttcatagtgctacctccataaaaaataaaacaataagcaaaacatcgtctatacgatgttcctagagcatagcacttttcttatgaaaagtcaacgatttgtcgaggaatacatagaataaaaagtaaattgtccgaatttcaataaaattcagaaaaatcagagacagatgacagagcttttcacacttcatttatcagatgcataccctgaaattataaatgatttgctggaggcaattatgaaaaagaaactgttatcagtacttcttattaccgcccttggggcatcactacttgccggatgctcttctgagaaagactccgtttcagacaaaacagaaaaaaaggtggaagaaaaactgaccaaagttaccttaaacgaagtcgcccattccatcttctatgcacctatgtatgtagcaattgaagaggattattttaaggatgaaggaattgatctggagcttgtgacaggatttggagttcacaagttaggcgaagatttaccctcacaaaccgcgtatttccgttattttgaagattttttcttcaaaaatattatcaaaacatatgtttgcttttttcgttatgtttcgtaaaagatgatacaatattttctccctccgaagtgtatgccccggagggattcttcaaaaacttttcgtccttaaatcagaaatttattgataaaatattcctgaccttttcctgtgattttaggtgttcttgtaattctgttacacccgttcccgtctatgtgcactgattctttgatttcaaacagattttgttccatgctacgctgtgttggtaaattccagtccgtcccttttcgtttaatcaaatacccattctcccgcatccattggaaaatacgttttgctccgatttcgattccattctgttttagaatctttgcaagatcacccacaagaattgacgtatttgccgttgtaattgcttttcccagtacggcatgtggtttcatttcctcgatctgttttttgttttcctcgatcttgctttgtgctaccatcaaggcttttgccaaaagttcatcatcgctcatgttctcctgccctgccatatatccgccatgttttcggattgctggaaggacttcacttgtcacccagtgtttgaacctccttgctgattcaagcttacttccaaagataagcgcatataatccagattcattaatgacaatcgccccgttattattaatttcggaggttgtagatgtacaccctccaaatgctctcttaggcaaatgctttttatcttcatcggctacatttaccctgattgcctgttttgtgtccacataccctaatgccactgttacgtccttacccacaaaccacggctcattgttaatagttactgtccggacttctccgaattcttcacttttgaaaatctgtaattcattcatcttcttgacctccatgtattgcaaaaggcggagatttctccccgccttatgacttctttctttaattttttacaatccggatctgtactcggtcaatcccaattccataaatcccggcgtaggcatccgcgcccgtgctgtactggctggaccaggaaagccatccggttcggtcggtgagctgtactctgacttccgcatgatatcccggtttgttgacaagctttacctggattccgtcgataacgtgtccatagatcccggcgtaatcattcggagcctttccggatgcgtccgtcacccacggcagccactggcctcccctcaggtgtacccggtactgtaaatttccaactgcggactgggagccaactgtatacgctctcagtccggtgaccgccctgcacggaatccctgcgtagccgtcggaactgacattattatagtttgtcacccacggcagccattgcccattcacatatgcctgataccggacattgattccggatgaggatacggacccgccagtggacggtttactcggtttcgtggaggtgttcacggagccacctgtatcggctggaagatctttatctcctgctaccatgctcttaaaagaactccatgttaccgggtcgtcgttcagtacaaacggattcggacagtatttcccgaccacatcatagtgccggaccacacgggacaggggaacattgtacttcttcatcagcccctgcaccagcttcactgtgctgttgatcgtggcgttttcaaagtaccagtccttggacgtatcactccggctcccggacgtccttacacacatctcaatattgatgctgttgtagttggtgcatttcccatagacgcttccgccctttgtgcctgggtatttgttaccgcctaccgaccaggccgccagactgtcagacacactctgccagacctccccggagtacccgacaaaatagtgggcggacgccccacggtatccagttgaaaaataggtcgcattgtttgcggcacttcccggagccccggtataatgcactacgatgtacttgatcccgttcccgtaccggctggacgcattgatggtctgaagcttctggttgatcggcaatccgttgatggacgccgcctccgcccggatcggcggcgctaaggccattatcccaaaaatcagggtacagaaaaggacggctgccaacgcaaccgcccttcctcgtttcagtaatttattcttcttcgtccgcatctgcatcatcccccttgtgctggaatctccagaatagatctgccacataggtccagcccttggtcgctaccagtgccaggacaaatccgatcacgatcatggcaatgacaaagtaccatgtcaccgggaagcccgtcatatccacataggcaaagtacgccaccagggtaaacaccacagacagcaccagaacctgtaaatcggtcgggatgctgcgcagtcccggcagtccttttgtcacctgggtaatcacaacggtcaggaaacagataacccctgccacaaaaatcaggagattgagattctccatcaccattttaaaaatatccaactgcatcgcttctaccataaatcactcctccttttatttacttttttccaacttatcaattctgtgatgtgctgatttaacggactgctccacagccgtgatccggcttccatgttccacgatttcctccctcagtctgtcaacattttttgatgtttcccgtacatcagaggcaatattatccagctttgtactgattttagtattcagttccgctcgtttcactgcatcatctatatctgtttttttgctgtttttattgctgtaatatactgatgccaaaaatcccaacagcgatattacaagcgcaatccactgagtattcatacccacttctctcctatcattttttacacaaaaataagaccggttcacggtctcgctctgatctccattcttcattacccctcttattttcctagttcttctttcactttttccttccataaagtaggaaccttttctatttccatgaacccttttgcaattctatctacataaaatgcaaccattacttttctcctccttccgcaatttcagatacaacttggccaagatcttctaatgctccattttgaatttcctgtcccctttcaatcgcatccactctcttttccaactccgttttctctcgaaaagcaataacggaaaccacatttccatccggcgtcatatctgcttcttgaaacataggcctttccagatataagtcttcatattctcccgtcacctcatcgtctgttttaaattgtaccttagcaagattcccttcttttttgagcgcccctgctatctgatccagtgcggcaaaattatctgtttgaatccgaatgtaatccaggcttgctccatccataatttccagttctgtgttatcagttaatacaagtttttccattttttcttctcctctctgctcttgaaaattcattatgattataaaccgattgcaatgacctgtagcgcaaatgccgatgcagtaggtctatatttttttagcgtgaactgtgttgtggttatagcatccgcccatactgaggtatcattctgcccagtctgtgcctgtacaataacacacggtgcttttgtaaacgctttcgggaattttattacttgatcctcccaagtatttggttttgatatattgactgttttaactgcaaaagcctgaatatttcccaaagaagtattgatcgttttaatttcactattcaatgtcttcgtttcagatgtgattttatcactcaacgtcttcccctgtcttgcatccaggacacttcccgctgctgtggtagtcaaattatttgccacagtctgttttgcggcactgcccagtgtttttatatattttttgtaaaaatactgtagtccggttaaatccaaatatttcatcgtctttcctccttaacttgataatgcatcaatatctgatgttgtaatggactgtacattcgcgtctgaccccgccggaccctgtggcccttgtgggccggtggccccggtcgctcctttcggaccttgcggtccggtggctccggttgctcctttcggaccctgtggtccggtagctccggtcgctccacgcgggattgtaaaattcaatacggcagcacttgctgtacctgcatttgtgacggatgcctcacttcccgcttccccggtcgtaacagttcccactttaatactagctgctgccccggttgctcctttcggaccctgcggtccggtggctcctgtttctccttttggtccttggattccctgctttccttgtggacctgtcggtccggctgggccggtggcccctttttctccggctgggccttgcggtccagtggctccggtcgctcctttcggaccttgcggtccggtggccccacatggaattgtaatatccaatacagccgcattttctgtacctgaattagttactttagcactgcttccttcctctcctgtcgttactttcccgattttaatggtcgccgctttcccggccgcaccagtcggcccctgttggccagttttcccctgcggaccttgtggacctgccggtcctgtcaccaaccctaaatcaacttcttttactgccataatcccctcctgctattcattttcatagctaaccatcagatgacccctttcatcaatccgaaatgttggcgtcttcccatccgccccctttggaccctgcggaccagtttcacctttcggcccctgtggcccggtggctcctgtttctcctttttgtccctgtgaacctgtttcaccttttggaccctgtgggccttgaatctttcccacattattccatgtacttccatcccagacatacagattcccgtcaataatatatccgtcacctggttccgcatcttccggtagttctcctgttgtttcatacgatcctttaatattgaccgatttcccatcttctccttttggtccttgcggaccagtttcacctttcgggccttgcgggccggtagctcctgtttctcctttcggcccctgtgggccggtttcgccttttgggccctgagggccaatcacactacccaaatctaattcctgtgccatatttccctatcctttctatgaaattgtatatatcaatttaccatctcttattgacaatggcggcgccggttcattatcattatgtgtcattatcagatgcccctcttcattcacatacattccaaacattcccggattcagttgtgtcacagatgccactccgtcttccccttttggaccctgcggtcctggcggacccgtctctccctgaggccctggcggaccttgtggacctgtcaactctcctgattctattttcccttgtatctctcttgtgatgtcctctgccttctttgatgcattattcgttctcgtaatcgcatcagtagcttgtcctatcaaccccaacaagacagattcttcttccggatcgggttctggcaattctccttccagcccttccaatactttacattggcgattcacagtcgtgttccattcatttttcagtgttccatcatcgaccgcttttttagcacatagaataaacttcacattgcctttgtattttgttactttcctcgacagaagccacgaaaacaggatatttccctctgatagttctacatcatcaatgcaatacaccccaaattctccattggcattttcataattgataaacagaatcagttcggataaatcgatatgatcccccaccatcttgggacactgaaataaaactctttctaccttttcatccgattctacgcccaataactggatagcatcaggaacaataatctctcttgtctccggatcgattctgcatcgttctgtctcctgaatctcctcttcttccagattcatctccgcaaaaacttcttctaatccagtcattgcctcaccccttcctggtgtatagttacggaatttgtcgtgatccggtatccttcccttttcccatacagtcgcacctcaaatgacgtaaatgtcagcgcttccttcggtatctgacaccttccatttatcacaggagcataatattcttttcccagtttggtaaatccggctacttttttgcatcccttccattcattactacaaaaaaattccgcattgagatatccttctgtctccgctacaattccactaaaatcgcattgttggtccttcacaaggttctggcctttcacatgaaatttcaagatacgcatcacgaatcgcctcccaacgcatcaatatctgaattttcaatttgttctacaccttccacctccccaggctccccttttggaccctgagggccttgcggaccggtcggtccttgtatgccttgtttcccctgcggaccctgcgggcctgtcgctccccgtttccctgataggtcaaccagaaactcatacccctggctccgtttcttatatactgccgcattttcatcgtcttctacatttcccgtgttgacaatcaccaatgacccttctgtcagtccgtctgaagaaaatccctcattcatatcctctatggaaccatattcttttagtatattcatgctatacatagtttctgtttctccatcatccagatcgtcaatctctgattcagaaatctcgactggatcaatatgttccaaccttccaagcgcatcgatcaacgcctcgtaatcgtcagaactcgttatattggacattgctaccaagttctggcttacttgaatatgaaactcaaaagaggttacaactctgcttttatccatcaaatgaagctgcgcttttactgtcccactctctgccagcatctgttccgttaatccaaaaagtacacaataatcattgaatacggtgccttccgtatatgtttctttcccagacggttttttacagtaaacacgagctttataaatcattccctccgtccctgacagaagcaccttaaccaaacgcccggtatcatgctgtgtcgcaaagatcacatttgtaatccctttgactcttaaatccaaacttaaaacttttgttgattccatcgttcctcctcccttttatgcaggaatccaccgtacaaacgctacattcttgggttctggaggtgtcacacttcctccgcctggatatctcagacagtatccccacggatagttataatatcttgtaacccagatctcttgtcctgtctggtctcctgtctgtcctccaaccgttcccccaaactcattgatgcttgcctgtacgacttgtccgtctccgatgctcatggtcgtgtgccctttttgcccggtaattaaaacgtctccgcgaatgattccagagcctgaccggaagttcacctgacttgtcacatcttggaaacccgccgccataaaatagcttctcatatttgcggtattaactgccgtccctccgccgatagacagacccgcttttcggtacgccgttgtcagaaacgaggagcagtcataatccggtccccatcgattcccttggtcatatccgtgcgagctgtcatttgctgtatcaatggcccattgtaccgcttccttcacaatatttttcaggatgccatcaattcttgtatcccattcccgcgcatagcgaagccggttctccatcattggagtcccggctctttcatagtttgcctcccacgcataggtaagccattcgatatcccttgatgattttatgaaatcattaaaggaaatattgtaagcgcttgtcgcatagtactggatccctgttcttctttcataatcagtaaccgcaagctggcagtcgatggtcaaataatccgtcctcccgatcgcccgcgctctagtctgtagattcgttcccggtgtccactgattcaagcctacgccagaattccagtttccttgtccgctctgaaaggaggccggattgaggttggactcctgctgggcatttgccaggtacgcaacaatcggatttctagcccatccgtattgttcatttagcttttttgctatctctgttccattctcaatgtatcccatcagacagttcccccttcggcagtcttccctcctacaaagattccatctacgaagtccatataggagccatcagagaactccgccctcccggtttttgttgtcttctcatcaactccaacagtaccaatatgaatattgtctgtctgtaccgtatccgcctctatccgatccgaccggaaatgggtatctcctgtttgtccatcaggccctagtatcgctctccagtacgaatcacttgttgtctctccatgtttcatataaaggaatccatcggttgtcaccccaaatggtccaatcgtcattttctgtgcattgataactccttcatccagatcaaaataattatttcccagcttgtccgacaactttccggcaacgatcagatccgctatgattcccgctgctgtaacggctgtcttccagtcccacgtcccatccggcagcttctctttcgccacccgaaggccttgtgttcccgcttccatcgccccatataacgctgacagttcatccagcacttcgatcaaaaacgccgccgaatttgtcttttttgcggccgttgattgtgcgtacaggtttgctttcatggcatcaatcgtcccctgaacctgctccgcaaccagggagccatcttcccggattgttttctccactctctgtgctaccgatgacatctcttttaagtagttgtaacggaactcccccagctccactttggaattcttttttctgacgttatcgtaagtgatcgaaaccgccctcgctgtagtcgtgattcccaatttcttatttttgcattgtaccgtatctccaagcccgatcgcttccaggccttttacatttcggtattgttctgtattctcgagtgcgtacatatcacaagaataactgcatttcggtttgtccacaccttcctgaaattgttcctggcatcgtcttacaagttctctcctcagctcctctaaagaatcaaagctttcctctccttctttggcatctgtcgccagctttacgtctttaaactctaccgttttcgtatagatcaccgggtaattgtcactcaatggactatccacccacggggtttccccgtcaagcatgtaatcgttatacgccaccggaacaatccttgttatgacatccgacatatcaatctcttcttcgatctctttgcaattatatccgaattccgcccttgccccattatcttcgccgatctgctcattgattatcatttcataattgtcatagaacacctcccctccgaacttcttcaaaaaggaatgatcgccatcaccttgtacagcctcaatcaggtttgtccttatacattctacatatgctgtttttataatatcagaggatgcccggtacttttcctgccctcttgtcatatagttcaatacctgctgcccggttcccgatatttccagcctgttcagatatagttccttggccgcgtcatatagaatcggtctcgcatacgctgtgacgcgtatcctgttttttttctttttgtaaatccgaaaaagctgcttttttgagtgaaacaaaggagccgcaatcacggccccttcctgtataaatgtccatctcccatccgggtctattggatgtgataattccatttcccaacttccgttgagttcgcactctgtttcacagctttcaggcaacaatgtcatatccccgttgtgcaggaaatcctcgtttcccgcctcataaatttcaatcattataaccgcctccagtttggtatgacctggacctggaaagcaccatgatatccgacttcattttctccaggaagcaagaacagatcttcaaagtcccctttcgcggctttattcactacagtcccatccgacctataaaccagctttcgctcggtgtcaatgtatgcttctccggtaagttctactgaaaatgaattcccattcacagaaagctcacacactcctctcccggaaatatgatatgttggataggccagcagatagggattatacctcaccgctttacaactatattccgcgagcccatcctgcaaataggataatccatcctttgatataaataccgccttgaacgatcctatccgcctgctgcttctctcattcgtgtcaatttctactttagaaattctgaaaaaataatttcggtcatcacccagaatcaaatccgtattcctttcagaaagccatccctggatcagcctccaccgttccatccaagcatcttctggcccaatataattcatcggaatttcaatttcagaatcttcgtaggcctcttcctccaggtagagcatcccgtctcttcccgcaatctcaatactctccatcttctttttcgccgctggaatatctggtctgtctgatatgcagaccccaaactcagaggcacgccgtccaccataacagatatcatacattgcctttactctcctttcgccgctcgatatgcccgatgcttctgccccattttatccaggatcatgtccgtcatcacagacactaatttcgtatctccaagataaatattgttctccaccacaagctggagatcttttattacttcggacaatatctgtgccatgatgctattgtttctggagttttcctctctgatataagatttcaataagtcaatcggaagaacggcttcttttcctgcttccccgcctcccattagcgtactaccatttacaccaaatatggtcgggcggttcaaaatcccacctttcgcataccatgtgatcggcatggatggtgtacgcaatgacaacgggttcacagaacggctttttttgctgcttttctttttgctcttcccactggattttttatctccaaaagaaaataagtcctcaaaaaatcctactactttttcgactttatccttaatccagtctaaaatagggtctaccaaatcccggaaccacttgcatttattatacaaagtcacaagaccgcccactaacacactgatcagcgttatcgctctggaaataggatttgcgtttattacaccccaaaccgctttgatcgcaggacttagcctttcgaatcccttcatcaagcttcctacccctgttgtcattaatccaattcccgtcagtgtgggtgcgatcgccgcagtcaagaggactatcactccgatgatcctctgtgtgcttggtggaagtgcattgaatttttctaaaagccctgccgcaatctgagtaatctgcgtaataatcggagccactgtttccgcaagctgtgcggttgctgcctgaaagtctgccgttgccttatttccctctaccagatttttgttattttcctgccatttctgccctgcctgcatcagtccctggtttgccaattcctgcatgataaggtttgtcctctcagattccgtgcggcaattagccagtttttcattaaacgcatcttccgaggtccccgcccagttcaggacatccgcaaacgttcctgttactgctgctgttcttgctgtttcattgatggattctgccagcccatcaattggaatactatctccgtacttcgcccatgccccaatcgtcccgtttaccagttgggtaagttgctgttgggaaagccccattgcctgcaaatttgccgttgtagtcgctgctgtctggtcatccccaagaacgccgaacaatgtctgataaatctgcttggtttcctctgcgctgtatcctgacagttcacttgacacttccagcgatcccatgatttttcggtattcctcagtggcaggtattgtggccgctaccgccccgatgatccccgccgccgctgcggaaattccgctcatcttttcgcctgcacttttcgccttattcccaacatcatccaactttttggcataatcattcattctggcgcttccgctttttaacttgtcttcgacttcatccagcccttttttgtagttattcagcgatgtctttgcctgattcagttgatttctcttattttggattgctcgttcgtcccggttctctgccgcctccagttcatccagttgtcgggacagtaaagtcactttatcggaataatcttttgtctgctctgacaaatatttttgtgtttctttcagtttctccgccgtctttgtgctgtcatcccatgttgacttcaccagttcaaatgcggtcctgttttcctgtatggatgctgtgacttccttcaggcttttattgaaatccacagacccgtctgccttaaagacaagacctactctttgtagcttatccgacatatagtgcctctacctcccttcttctatctttctggaacacttcataacattcgttaaaaaagatcgggtctgaattccaaaattcttcttcactcattcccatctttctcgccgccaccatatattccggccagtttatttccccggcatcacactcgactgtgcctgtttttttttaacataccggtcatattcttcctggaatacttgcagtaccttttctaattgttccgtatctggagggacaagggaaagcgcttcgtcaaatcctactgttttcccattgcttcttaggattgcgtaaatcacataggccgccagctcaaagctttcttcttccgtcagtttctttttgtttttctctgctttcttctggatacgataaaatcctttctgtttttgcaggtaatagatcgtcccaaaatttaccctgacagaaagccttgtgccgtctgtcaaatcaataaaattttccttcatgcctctctcctttatgaaccggaaaccgctgacgtcaaatcctcttttgtcagtattggtttttcaaaaaacttttcttccgtcaatcctgccggaaatgcggatgaggaagaatcgaccatcgctttgatatcttcattatcattaaaggcatatgccttgatggtaatcgtgtctgtctgttcagaaaagctctcttccctcgttttcgtttcgtctgtattttccgcgagcctgcattttggataccactccagacgtatcttcccttttttcagttttacaacctttccatatgcaaaaaatggacgaattcctttccctcccgaaagaatcagaccaccttcatccactgtatctccccgcattttagccagtgtttctgccgggaacgcaatcacttctacttcaatatccgttgaagagacgctggaatctgtatcgtatacgatgccacttgaatatacatctgtgttttccgcgttttctgttacagttacactttttaccacttcggtgcactccacctcttcactatattcccctgaatattctccgtcttccgactgatcgaagcagatatactgcgccccgaccgtctctttaattggcggtttctttgtcgtaattgccattcttttttctcctttacttccataattccttgtcaatcgcttgataatacttctgtttatttttctggaatgtcggcatcacatgcggaaccgcatctgccctcactgttccattttctaccattgggccataatatttcccccatccgacttctatttcacctttcgttctccttgtcgttacggtatctaaaagatgtgtgtatccggacccggtcatcttagaacgtggttttgggagtttccttacatcatcggccagcatcttagctcctgtttctatagctgacaacgccttttcatctgttacctgataccgctgcataaggtcttccatgaagtccaatccacccgtgtaaaatttcatgtcagacatcttctatcacatccacggaaaagtaggtgtgccatgtttttgagaatacaggatctttttccacatattcgtgctgaaatttagggtgaatcccctgttctcgcaacttcttccgtaactctttatatttgtcatgctgaggtgtgcgggcaaagaacgagatctggtatgtaacaacattctggtattcatttccggaggccatttcgtcttcttccagatacggccaaaatacaatccttggatattcgttcgtgttcttatcgcttgtaattccttcatttaccggaacttccaaacttttcagtaaactgcttaattcctgttttgtcattgtattttcagctccttttctggacgaatcaacgtaagttccgtttcctgaaatccgtctttatccgtcacatgcgtggcattataaacatggtgctgtttcccttcaatcatacatacgcacctgctatcaatacccttatacactggaatccgaatcttcatcgtcacctctttcccgccctgatcgaattcatactttgtccgatcaaacactgataattcccgataccatatgtcccccacattggaattctccaaatgctcctctggataatccttggattcgtcctgccggatgtaataaagctgcattgctcctgatgtatattcaggcatctgcatgtgtcttcacctcacttcccatctgccagcttaaaattagagccttataattatcttcccattcattcactttgtgatggtaagcgtaatacacatagttttttaacaacattcggaaagtatagtcatcatccagactttgtcctggattcaaaaaatccaatcttgcttttccctcttccaggtatctcattaatcctgtatcctgaaaatacggcgggatctgataatcctgccgtatttctgtaatcagtttttccagctccaacgtcatcccctcctgctacttattccaaaacagctttttcaaaattgaaagtaatcacttccgattcatccacttcgatcttccatgtatcttctttggatactctcaaaatgatttctggatcaaacgtcatgttttcttttccttctgctgccactccatttttctttaaactcattttctttccggtctttgtaagcttgaacgggaaataatgcccgctttgttcttcctcttcggaggagaatcccgtgtatccggtaacagctttcagtgttccttcaacggttccatcttcatatacacaaagatcctctcctaccaaatcagaagctttcttacctaataagtcctgacctgccggaaacaatgtcataatgtcaggactgattattttccctgttctggagttgtcgctgtcgttactggaagcttatattcttccagctttgtgatatcaaatacaaccgcgcaattatcatctaccgcacgcccgtttgcataacactttccaatcaccagatccgcgtcgtccattgcttttgtctggtcatactcctttacctcgaaagatgttgctcccatcacatagacattcggaatggtaaaaattcccttcccctgcgggcagttcgcgtccacatgctttacaatcggcatgaaagatgtatttcggtatcctcctgttaatgcctcgccataaagcgccggatctacatattctgcttcatctaacgggttacaaatcagatgcagctcagaaacggttctcttcccattatttgtcagcgtttttctgacttccgctaggcctttcggggaaaactttttcactgtattaatcaccgctttatcgtcagccgtcccgtcttctttgaatgtttcaatctgcttcataatcccgattggtcccgtctttccatccccggaaagatatcccgtcacaaatccatcctgcatggcttctgccagaactgccgtaaaataccgatcaacaaatggaagcgccagatcccggattgctttagggatgacaatatacgctgtcatcttgtgctgttcaatattcaagcctttaatcgatgcggatagctcgccttgaaccgcatcggtcaggttcccccagactgcttttccggagtgttccgctacgatccatttctttacatctgctggcgccatctgtaccagggacagaatatcgctgctctttttgatatcatccaatgtacggtcaataatcgatgttggaaggatatcgatctgctctgccgtaatcgcctgtttaatatccttgaatttttcataaaaggatgtttcctcttttgtcagtacccgaagacccagcttctttctgtattcttcgtccgccgctgcccttgcgttctcctctaccagttcgctgatcagatgcttatgctgctcttcggcaatcatcacagccgcctgataaatcgcttcacttttgtcttccgcttcattcagcatggttacgactttctgctgaagttctttgtccaatgtgtcaattttcattcttttattctccttttcctgaattaaaaaaagcactgaatccagtgctgtccccttgtttcttactattttctttgatttgtttcacaactttttcagcaaccttttgtgcgatcctgttttcgatttcagaagtatcccgtattcccaatctcgtttctgatccatatagaagtctctgttggatccatttcatcgcggactggctgacaccttctggtttttcatccatgatccccgttgcaaatcctttctctttggcttcttttgctgtcaaccatgtttcgtcatccatgagctgcttgacttcttcttcggtaatcgtacatctacttatgtacgcattgacagacgcctgggtaatcttatccaaatcatctgcttgttttctgaaatcattcgcgtttcccactccatatgtccacgcattatgaatcataagaagggaagcgtcattcatcactcgttcttcccctgccataaatataacagatgctgcggaacacgcaaatccgtcacaataggtccgcacttttgcgttactgtttttcaggacattataaattgccagaccttctgccacatctcccccataagaattgatgtggacattcactgtctcaacctctaactcttgaagttctttgacaattccataagcatctttgtctttttcattccacggccagctcgtaatctctccgaagatatagagatccgcttctttcccggctgtttccagggaatagtatttctccatcttgccttatttctcctttcctaagcgttatttactgtttcacccacagttgggagaccaccggatcacctccttccctctaagtttttaattgtccgcattttcttttccactcttctcacctcccagatcattggtataattctttgtaattactctctgctggctaaactccgtattcaaagattcccaacctgccatttcccgtacctcatcaaaattgaatccgatgcttctcaacttatccaaattggccgcgctctcaataatatcgacatgtttatacttgctcatatcaatccagatcatttcgcctttcagatagtcttcttctcctaccaattttgcgttcagtgaatcattcagcaattccacgatccatcctacagcataggtaataaattcattggtactatctgctttttctgtgatttctccaagaaagaccgctttgggaatatcaaaggcaaatgcacactctaccatgatttcatttgccagctttacgatatcctcactggatacgtttgtctgtgcctgaagctgggacacttttagtcctgacgaatttgtaagcacttctatttcatctgattctaacaactttttaatgtcagatttatattggtcgattgtaacaacttttggttttccttctttgtcttttgtatgaatcgccggcatcgatccctctatatccaacgtatatcttggaatacttgaggtcttcttggccgcgcacattgcactgatcgtgctattataaatatttaacactttttcaagaaaccctataatttttttgtttctgctcctgagatggataatctcatttgatgtaaaccccctttgcagttttattgtattatcattggatataatcgtgacattactataggtctctgggaccataacagaattatttactgtaaatgaatccgcaatgtatagatgatttcctacatagcaaatcacacactcctcatcaagcaacaaacgccggatagcttcaatccagaaatccgtggccgtttcatttggatttggccgaatattcagcagccagtaaatatgatccttttctcttttcccttttctattgacgataaactcgcttttcgctattgcatgtgcgatcattcctaccgccttttcaatagccatttttgctacttcaagctttttaatgtttacggtaatgctatctgtatatgataccaaatctccttttttgttttgaaataagaaatcaaacatataccactttctcctttattaaatccttggaatacatcgataccagaaacgccataaacccatcattttttcttagcttcggttctattttcccatactgcttgtttccataccgatctgtcaacacctctgtattattggtataccaccgcataatggcagacgctccataattaatcctcccttccgcaaacagcttttctatctccggtgctataatcccacacacggatccaatcttccttatgagccgcatctgcccatacgggtctttttttgtttcttcgcgaattccataagactcaaataacatccgaaacaatgggtatctgtatgtatccattgtaattttaagtacataatattcattcattcgatccatacaccaccgcactatattttctggaggaattacctgtcctggtgtgatctcataatccgaaaattccggctgtcccatattttgaaatattggaaatttaatggattttaaaaacggggactcctcacatatccatgtgtgttgtctccagatatattctccatctttctccgtcaaaactcctgctgacgcaaaatccctaacgtctgcataatcaatcccaatgaccgcaagcctccctttggtatccggtgtctcccgtatcgtcttctttttgatatccgaataacagcatcgcaaaatattttcccaggaagctactgttgcttcatcattcctgtcaggccagttcatcctctttgtcataaactccggccttttgcttggcagctttttcatttccagataatcctgaaggatctggtgctccaaaatcggcatatattccattgaaggatttggcttatgccatgctaaccgatcatccgcttcctcaataccgtcaatcttgcagataaaggggaaatatcctaactggttttctccggtttccagtacttcctccatcagatccaacaattcatccattggcccctctcgtacatacccatttgtagtcaagataaattcccttggatgctttacctttccaagcgcggattcaaatacattgatctggtcataattttcataagcatgaatttcatttaaaaccagacaccctggacgtttcccatcttttgtcgccgcatttgatgtgttatacctcatttctgatccagttgctgtgtttgtaattaattctttcgtaactttgaactttcctttcatggctggaatattcatcgcatcatacgctactttaaaggtatcttttacctgctgttccgaatttgccacaatctctacatgataattcttcaccccatataatggtgtctggaaaaaattgaccagcggcactataaatccatctttcccattccctcttcccatcataataaaaaacttttgaaataccggcatgtcgcccacatacataaaggcaaaggcatagatgaatttctgatatggaaagagcttatagtagtgtttttcgcaatattttaaacagttttgatatgtttttttgtcaaaaaaaacatcatttctccgtaatgtcggcaaaacgatgttcttgatcagaagcgatctctcccgatttatttttttagggttatcctctacatacctaagatattctgcaatttctttgcaattaatcattacagataatcatcctctgctgaagaatttgaaagaggttcttttaaattcagatcatttaatattttcagcatggcagttgtgatctttggcagatttgtcacggattcattgggtttttcgaccttgataccatttccattaaccgtgtcgtaccggattccttttttccggatatctgtaatcaacttcttttttagactccagtaatccatgtaatcactaactagatccagataaaaatcggatgttttattctgtaatcttaactgttctaaaagcgattctttaatctctgtttttgtcacactaccacctcttttctcacattatagcgtacccctttcacgcgcgcgcgaaaatttctccagagtcatggccacatccccgttctccactaaaaaatttttcattgagaattcacccggggggatttcttttttgttccgaaatttttctaccatttttcttctgtgactggttctttctttttcacaaatctttttggttgtctcccatgccttatgttgtgacactgtgtacataagctaatcagattctcttcatcaaatgcaagctccggattttcttttagttccttgatatgatggacctgtgtcgccctccggatctttgcatcttccccgaataatctttcttctttttctgctgccgtccgcaacctttgaatacaatcctgacattcgtatcgatctcttatcagtatcctatctctgacccgctgccatcgcgccgaattatagacctgctttacttcctgatctgtcatgtaaatctccttaactattctcatattaatttactacatgtaaaaagcatccggtttcccggatgctctcttcttattccttattcgattggtctataaactccttcatcatcttagtgatctgtgtccccatcgcaattcctttgcttttgcacacagcccgaaactcttctgccactttttcatttactttgtaggtctttgggacaagccccgcctttgcatcccacttatcctgtggcctaacctttttctcttccatctctcacctcgtatacaatattcaaaatattagatatcacgcttatgatcagtgcagttccaatgatccagtcaagcccttttgtcacagcgtagtatccaagcaggaagagagataataaatttgatacaattatactttttctcatagatttatttgctgagatgacttataatataggcgatgggtggcaagcccaccgcctagcacctatttgaaaaacgtctcatagattaagcaaatcgcagttaccagaccgtttattatgctgactatgagtgccgctttttcaagtcggtgctttttcttatgtttcctagccatctccattctcctttcctcatttcttgattctatcatactatatacgtatacgtatgtcaagagttttaatgtttgttttcgataaaattggttctattcattcactacctctttttgtaatacccacgctattttaataattcttaataattagttctttatatcgacgtgggttagttttcgatacaagattgtcctgcctgtctacttcaatcagagtataccctatatacagtttccgaatttctggacaatcattataagataaaataaatttcccttgaatctgagagattgaatctctcagtctcacatgatcttccagttgaaacctgtctgtataatatttctctgcatggtaatatggcggatcacaataaaataatgctgatttgcggtcatatgtttttataagccgctcaaaatcagcattttcaacaattactttattaagtctatttgacacttcccgcagataagcaatcattttctgcaggtctcttggacgcacaccaaacgattccaagtcagagccaaaacttaatttaattctacaatagaaccgtgctgccctctgaatgtctgtcattccttggatattattctgggcaacacaatcaaaaaactgttccctggacactaaaatccagtctaattctttttgtaatgcatctggatggtatttaacacatctgaatagattcacaaggtctccgttcaaatcattatatacctccatgtctgcatgtttttcttttccaaacagtacccatccggctccgccgaatacttcaatataacggtcaaaatcccctggaaactgttccattatcttctttctcagtagttttttaccaccaatccagcttataaagctgttcatgttatcaaccctctttctgtaatactacgtgggtattatttcaagaggtaaagcgaagcacccggagtcgaaccgggacacaggtagcgaccctgcacatcttccgttgatgatatgcccgcatgagaaaagcaccccggagggtgcctttgttattagaactgcatttttccttggactccactgctatatatggtacatctttgtttctgtattgtgtggagtaagatcaatcttttctattcgtcctattttaaagtatagcatttatatttctcctattctttaaatatttttttcttcatatcctctatctgtttctctgaatactttttcctcggaacatgtaaaagagataataactctatcatcttttttatcgaaataataaaatatagaatactaattaatagagaaaaaatttcaatataaaagagtaattcgcaaatcatactaattatttcttcattaaatatctttcttaaaaaattgaaattaatttttaatacccaaaacattgaaataaaaattgatatagctccaaatattatagaatggccaatgacactgttccttttttgtaaaatgtctgttccttctaatttttttatcaactgatcatcgcttatagttaaaagtatccccaaattggtaagtgcaaaaccacaaaatatagaatttacagttaaaatatctgtatgataatctacagaatttttgcttggcataattataaatttataattatacactcttgagagtatgcacaacacaacaacaaacacgaacaaaatcacaaattttgtaatataattctgtttatatataaatttcactcgccacatctccttatctattggctatggcattaataatatcaaagttggactcataagccatatgcagtccgtgcttaaattgatccaccaactcctgcaaagaatattctacttctttcccttgaattgtacgaaactttttcacttctatggggtatgtaaaatattttgcatgcagatcaaaatttctacttccaaaactctctgattttccacgtataacagctttggaataattcctttttttattaattagtatatctaatacagcctttaccttttcctttttacttatcaatttatggtatggcgttgctttcaagattataaccgatgaatatacattattctgtatcatctccctaattatttcttcatctaatcccaacacagcttgcaaaaattccgcattaggtgccggtatttcaaattcaagctttgatacctccggagcggttgctccatacaagacagaaatgccatcgctatttggtatactttcgaaattaaatttatactcagagttataatacagacacaatgcatccaatgctttaaaattaggagctcctttcgtgttaacaactgacaatatacccttatcataatcaagaataaaaaaagtatatacctctattcctttatcgctaacttcgtaatcttcaaaaacattattggcttttagagtgctataatctcttttgattacagtattatttgctttttttcgtgctatacgtccaaaaagatatttatcgtcatcaaaaacatccatgacttctttcggctcaatacttgtcggtaaaatgtctggcgataaatcaatggatagataaccatcattatcaattgcgtgttcatcaattatctcgctaacaatttctttaatctttttataatcaagttcctcatcctttgcgcgtgtcacaagcacaactttataaaattctgttgtcatagatgccatgtccatttccctccacacaaatttttcaaaacgcaccacgttttctttaataatataccatattttgacagatatcaacaaattctggtgcttctatttagtgtggtagtaaaactatgatagaacatttgttctgttaaatcaattcgcaaaatgcacaaaaataccacacaccgtagtgcatggtattttgatgtattgtgtggtagagacttttccgagctcaacaacccatccagaagtacttcatccacttctttcagcatatattatagcattttaaaaacggacaatccggacgaaagcggacaaactttagtttttttgcataaatctatcatattccttcctcattgcttctccacccgctttacatttcatcagcgtcgccgtttcctcccaactcagtccactgaatatcttgtaccggatgatccgctgcatccgaaaggggatctccttcatccactcttccactccaatcttcagatccgaagcttccttcctctgctcctccagaatcctcttctctcttgccagcgtaaaggcatctgctgccgtctcaaccgatccgcccaggctaaaagaccgctcttcgtacggccagtctggattactcccacgaaccttgtcctgaacaaacctctttttcttctccagcttcttgatctctgcttctgtctccttgataaactcgcaggcatctatgtagtcttcaagaatctttttgtccatcggcatcacctccaatcccgaactttttcgctatgtactgtgccacatcaaccgacttatacggctgacgattaaagttcttcctggcatcctcccgcacatccgtctccaggcagtcatagtgattcgctgtatcaatcttcttttcgtgctccattctgtttcgtttcaatttctgctcctttctccaatcggtataaatctggaagaggtcgccaagcatacactttcccgtcatatattccgtaaacgtcataaaataatccattaggttttacatctttttcatatcgcatctgtttaaccggaacttctgcatcatcacatgttgcaagatatatcccgttttcatccggcagacgctcctccaccggaatccagccgtcattcgtgtgcttgcggatgatatctaccgctctatgtcctgcatcattatctataatgcatccctctgcctttagttgctctattatctcttccagaatcttctctaacatgtcagtcctcctttaacatccctgtatgtatacaccctcaaagtttcctgtattctcttcgtctttcgatacttcaaacacatttactgtcccaatcccatcattaaatggattatcttcttgatgatagaaatacactgttttacttttatcattcacattctttaaaaattcttccagctcttttactgtcatgtcagtcctccttttcccaccatctctgtccacattcatcgcagaaccggctccacggaactgccttgctaccacatatcggacaaaccatcccatcttccgtttgcacgggtttcttcgccgtatcccgctctttcagcccctgccacttcgcagcttcttcgtttgtcaacagttctgctttttccactctgtctggatcaccctgtgcaatatagaaatcaacgaaaaaatcaataacctgattaattgtaatttcatctccgaatatattttcgagtttctgaactgcttctttcagctccatgatctgctccgggatgagcccggtgtcctcgtattcttccaggagtgctactgcattgtacagatatcctgcatatacttcttttccgtcaacattaagatttcctttctcatctctgcttgttaatctctccatctctgatctccttctctgatctccttaatcctcgaataagccaccgcagacagcctatccacagcaaaatttagctgacatacaatctcttcgacatccgtcgagacagatattctgtttatgtttccccgcagcgtatcaaggatctgcatcttttcttcgttcgtatatggtctgtctaataacttcgccatctctgatctcctttcgtttgttgtgatttaattctcatcaccacaaatttcatctaagaacatttgacctggtatatcatcatttcccatccaccagtcgaatacttcttccgcgtttttccaattactctcttttcctctcctatcccgttccttcaacattctatcaaaagcgtgcaagtaaagttttttatatttcggaaaatctgcgaattcccgataccgtttctttccagccatcggacaaccaacgcatccaacacgatcatatccgcagttatatagatcacatactttaattttttcggaatgtatatactcccaaatatccgtatatgtccagtctataatcgggttcacaaccatactatttttctgcatacataattccgtcatgcgcctcttgctgatattatcttccagcaacattaccgtgctgaatttttctgcatcattccttgtctttccaattttctcaaactctccacgggactttctcttcacactctcttcccaccttacacccgttgcaatatatctgtttcttaccccattttcttttagaatctggcaacagtatcttactaattgtgtaggaggcatcagtttttccggtatcaatttccacatgctggtccgctcgcccttgtatgtaggcatttggatctcgcatgtgattccccccagttccagtaaacggaaggtctcccgtatatgatttactgtctgtggagtatcagccgttgtatgactgttatgcacctcaaacggtattccggatcgtttgaacaactctagcatcacatcactgtctttccctccgctatacgtgcaaacaagcggttttccatagtgatgtaggctcatttcacttgccatctttattctctctattgattttttctctttatccatttttctaagaagcccggtatacccttaccccggccggaggctggctcctttctcttgttctggtttaaaccctttttagtttccgccttgcactgttcaggtacttcgaaaacgcagactgtccaatcccaatcatctggccacattcctcttgggtcttctctggatgctgaaaccgaagcagtaccgcttcccgctctttctccgtaagatctctgtttcggatcagatcatgcactgtttccgacattccaaaatgatctctggtatctgcaatcgtgtctcccagtgtcaatccttctgccccactgaccggatccccaaaatacacgactttttttcgtctgttcctcttcctcagctccatccggatctcattctccatgacacttaccgcataagtgctgaaacagaagccacgctcctcttcaaagctcattgccgccttgacaagcccatactccgctgccgacagggcatcctcccactctatcccagcttgcttcacccagcgtttcgcaacgtaccccgcaagcgggacattctcttctaccaatctaatctctttttctgtcatcattcactcaggagaaaccggttattatgcgcgcaactcgttctcctttctcttgttctggttaattatcgtcctgctctggatatcctctcccaatcttctgcgtagacttccactgtgttccacttatatccgcactccaggcatttccgtctccggataactctgtctacttttttccgatatctgcgatctatgacttctgtctggagtgacccgcatctccggcactgatccccctcgatctgcattttttgtccctccttcctgttttctatgatgttgttccacagtcttccaacgcatactcctgttttcttctcttgcaatcctgtaccatacctttgagaatctctatctcctcttcattcagataaatgtaatacttttccagcattttcaatacatggagctttcttgcatacgtttcatcctcttctttcgttgcggtgtccaggatgctttctgttttctgttcccggaccgatgctttctcttttgtatcctgccgctccggatccgggttctccctatcttgccgctgccgctcttcctctactatcctctgaatctcactcgttttttcgtccgctatgtctggagtgtctacttcttctgattcttccaggtagtcctcctccctcatctgtcctgggatctcgtcctcttcctcgcactcttctctgtgcgtttccgcactttcctgtgttttttcttccggctctttcctgctgccccggatttccattgcggtcattcccggatccacctcttccagcttttcctccgggaggtacagcatctcctgtagctggctcttgttataccccttatattcttccgccagatatggactgtatcctccttcggagaaacgccggttaatctccatccatctgctggcggtcgtcctggtgatcccaaactggtctttcgcacaatcccagattgtttcatatccatcctcttgatatccttctgtctctttgatcctccgcaggaaatatcctaccttgacgaaggagtttcggatatttcccagctcatcccgtatgatctctttcgcgtcctcataattcgtttcctgataccattgccgcgctcccgccgcttggatgctgtttccattcagcatctctattacgtcaaatcctgccatgccatccacctctccttctcatcggtttcccgtgtagtttcctccaattattcgtttcctctctttcgatcttcgcaaatttttccgcaagctttttcgcaacagcttctatcgcctgctcccaaaccctgtgaaactgatcccatgagtccgtagcctcttgtgctgttttccctatttctgaaagcgcatcattgaatgactctatctcctccaccagctcttgttcctgatctggtttcccctcactctcatcgggaaccctttcacacgcgctttcctcttcctgcttctttgtcatctcttttctcctgggtttccggatccattccagaattcttctacaaatttccaccttctcttccttccctcatctccaaaatagtctttggcgctgttacatactgttccagtgcacggatcgcctcgttcccaccataacagaccaacgcctgatagccctggatcgtcaatttctccagccagtctttctggttattacttggccggttctccccgacttttagttcaatgtacagtccggcgtatccggcgcggggaaccgggagcaccaaatccggcacccctgccctcactcccatccgtttcaatttggacgcctcggctttgttcctgctgcccccattgggcacatggtagagcaattccaggtccgggtaagcattgctcatcagtttggcccagcataccaccttctcctgctccgcatcttccgatccggtgagctggatccggccatccggtgtctttctttccttgactctgtaatttctcacttctttctcctccactcctttatcatctctatggctttgttccactctctggaaaatctttccttgtcttccagtgtcatggtttccgctgccgttctctgatatgtcgtaatatgctctttattcaggaaatcccggaaggacctactgctcccaatttcccatttttcttttacaattcgatatgcctcttccgcgtcatgctcccacgcgatttctgtgacctcttccagatgtttccgcaaggttcttcttgtgattcttggcgctttttccacggtcggtcctcctttctgtgatctccacttctccggtctccagattcaggatataagattcttccctctgccgttcccggtctgccttgttgtccggcagttgtaccagcgtgtaggaaaaatacaaataccctgttatctcgtgccaagcctcccggatgctctccttatccacgtaccatccggccggaacctcaattttatggctataggcgttccgtccccggatcttctttttctccggttctggaatgataagatttttactgctacagtatcttttgttgatgaatccttgctccgtcttcatggtcttgtccgaatacttgatgaaatacccggccagtttccggtactgcccgctcttatccaaaggcttaatacagatccatcccttttcccatagatctcttatgatgtgtgatatatgatcgatcccattgacaacaatatgaaggtgtgcagctcccctctcccctttttccgccgtccatatgtatttcagttcttttccgtgtttccggtagatccttcgcagttttcgtaaaagtgttcggatgtcccggttcaatgtctcccgatccggccgcttctctttccggtagctgagtgtaaggtaataatcctccccggaaaggttggcgttcatcaatcgggtgagttttttctcggccatcctccggttgacttgtctctgtgcttctggagtcctgttctctttctttttccggctccctcctttctggtcaaatcgatatgaataataaaattcatactcttttgtctttcccgccttgcaggtcgtcttgatgtatggcatctcctctttcctccggtttcttgtccttgaaataatacccttatcgagtctcaaaggggattggcttccccctgtttcaaatgcggatccgtaccctccggaatcctgcgttgtcttttcccgccatacatgctatactgagtatgtctaagatgtatggcttaccctcccttgagctgtcgggctccgggagggtattgtatttcctatttcttctttctgttcggattgtcctatctcagataatgaaatatccggtccctttcttttccgcttctctctgtgcgtactcctcagccgcttgccttgtcccatacaggcacccgatatctccgttttcatagcggacaatccaaaggatttctttttcttcgtttccattctttttcatctttgaattccgattatgatagttgtacttttatgtaaaacagcatctacaagctccatctgctcctgatcgaaagggttctcacccgtcagatggtctattagttctcttgtaatctctgccgcgtacccacaaatctctatctctttctcctcactcgttttcttctggtcgcatattctgtttgctgccaagaagatcagtgtttccaggtcttctttggtcagttcatattttctttgtttctccatttgctttttcctttcttatctgtcataataaagttggttatttttctgagtgcatatctgggattgccgtccctatgcactctttttcatgccctgcagccggtgtctccggcgcagttcccgcatctggagataatgcttctccctgtctttcacacagtcatgtgttatgtatgctactatcatcatgtccagcgcgatcccgaacgctataaaaaactctcccgttgagatcagattctggctgtaactgtcagcagatccggccatcaccagtacggcaattcccccgaccactgcacagatgtctttcaagatccggtatttccgcagttttcttcgatgcatcgttatcacctccttgttgcttgtccatctggttgaccgcctaagcggttttctcaatttcgtatttgatttctacaccctcctgttcttcaagaaggctgattaatacttcaatgaccttttccatatccatatcatcacctctctaaaatctattcctcacggattgtccgggttgcattgtccttaactcctgttctttttcctttttctctggtataattttcttatcaattaatgaaaggacggatatcatgccttataaatttacccctgaatactcaattctctcttctatcaggaaagaattagatcccgtaaaggaacttgcttcttcagccgaaaaacttgccaaatcatcagaggaacgctctcaaatagccgaaaggcttgccaattcttccgaaagcatcgctaagtcatcctagactcatgccaaagcttccgaaacgctctcatctcttgctatcaaaaaagctaagaaagccgacatcaaaggctggatcactgttactgtttctgttcttacttttattatggaaatttgcgataggctcggcctattctaaaatgattccagaaagaacaaataaaaagtttaatatcgctaataccagagccacatccgaaaccgttatctttgacggtttcttttcttttttatccttcttcatacttccacttccttctcatctatctggaataagtagatttctcatactttgatggaaatgaatacctgtgtaaagatgtagttaaaatcgaaatccctgcttcctcagttcctgtattggttgtaaaaattgaaaatatatagacttaatcagagagatgtgttatttgcgcatctctcaagtcgtgtatgaataattcttcaaaacatcccttgacataatttcctatatctttgtctctgtataaaagtccggtacagtattttttgcacttttgtcgcaattccccgtaatcttttgattcttctttcaaatctttgtacgctttggtagctaaatctcgtacttgtaatctaaacttttcataatccatgctttcacacctccttagattgctcttatcttccttgcagactttatttcaaagttcatcccctgaatagttccaatcatcagccgtgaggtcatctgctgttggattccatgaccttgcggctctttccgcttttccatatctgcttataatcagttgacacgtttcataactatttgatggctttatcacagcgaatatttctgactcaggtcttcttgcggatttacgaaaaattattccatttatctccaaggctttctttactgcttcatgtatgaacatctatcccacctccttttcctctgtctggaatgagtccgtattatcggacacactctctgctacactactctaggaagtattcgatagatactccgaagtagtcggcgaggattttgagcttatcgactttaggaacactccgccccgctttccagttggaaaaaacattttgaccaatccctgtctcttttgaaacttgataagttgttttgttggttttatccaataacgcaacaaatttttcgtacacttttacacatcctttcataagtaattttgttgattatactttcaatatgtgatatactttcaaatataaaactaccacattttatacgaaagcatatcacattccgaaagtttgtatcacgctttactttcgtttgcgtaactaaatattacatcagcattcgatattagtcaagcatttttactcacttttgcgaaagtatgctatttttgtgaaaggagtacaaaaatgtatgagatatttgagcaacttctacaaaagaaaggtataagcgcatacaaagttgcaaaagaagcaggtgtgacccaaacagcattaagcaactggaaaagcggtagaaacaccccatctaccacaacattgcagaaaattgctgactattttggtgttactattgattacttaatgacgggagaagataaagaaagtggtgataaatactatttaaatgaagaaaccgcagaaatggcgcaggctctttttgaaaacagagagctccgtgtactgtttgatgcagcaaaggatgcatcgccagaagatttaaaaactacttatgatatgctaatggcattaaaaaggaaagaacgtggtaacaatgaattttgattatcaagtattcttcatggacggaatgaccgtaaatgaagcaataactgaaaatgaagatggctcatttaccatttttattaacagcaatttatgtgatagcaaaaaactaaaatctatcaatcatgcaatccgtcacattactggacgggattttgaaaaagaaaatgtgcaggaaatcgaaaattctgcacatcaataggtataaccgcttaggcgattatatagagtggtgtttttctcagaagtatacagaaagcgagaaatttacatgaaaaaactgatgcttattgttataaaattttttttaattattttcactgcttttggttgtttaggtatttttgttatgatgaaacagtctgaccgttctggcacgctcatatacacaatctggactttaatcggttttatactgcttgtcattctcttcaaacgtcctaaacagtcaaataaaagtgttccggacactattgacaatgattctaatgtcgtttcaaatttgcatgattctcctccgcaaaaagacgaaacagtcaatttgcctcgcaaaacaaatattattttaaataatactaaggaggcaccccctccctctaagcaaagcattgaaacatccaccagctctcccgcttcagaaaagcaagagcatttaaaaattgccggtacatcatttaggcaaaaagaaattgaatcgttgggatctgaaaatatttggtatgattgttcaaaaaaagagttaattgatgattttatgatagacgaaagagtttatcaatatgatttttttcctgattccgtggaacttatcgaggagcctgataacccacatgatcctaatgctataaaagtaattatagataatgttcacgttggttatattaaaaaaggcagctgcgctcatgtaaaaaaattacttcatcaaaataaaataatagatatcacagccgatatttctggtggaaagtataaatatatttctacagattatgatgttgaaaatgataaagatatatatgtattagaaaaacattgtgtcgattactctgtctcacttgatttaacactaaaacaataatatattatcccacgcacttctcagcgcgtgggatagcgtaatatatttacccaggcaactgggagggcgaatccatccgtttcgagtcttgcgaaaggggtggtgcttatgagtacatatgaagagtttcaagtcatcatatcagtggcaatactgattgttgcaatattgaactacctcaaagatgatcataaaaaataatcgccctgtctctggaaaagctaaggcgattatcttttaattactttacttcccggagcggataggtttcggctatctaccccagttgtcttgttaagtatattatagcaaatatgctttaaatgtcaactaatcaaaactttttacacatcacaaaatttaagggggtgtacgctttctttttctttttttacgatgaggaaaccgatactactgttccggtaccggtggacgatacagacatcgaagacaatgaggaacttgaatttttctttaacgataaggtgaggaaagtctggcataaacaggaggaagaatggtacttttctgtggtagatgtatgtcaggtccttacagatagctcagatgggagaaaatactggaacaaactaaagcaacggttaaaagaagagggaaatgaaacggtgacaaattgtcaccagttgaaaatgaaggcctctgatggcaaaatgcggaaaactgatgtcgccaacactgaacagcttctccgtctcattcagtctattccttcaaaaaatgctgaaccctttaaagcgtggttggctcaggttggaaaagaacgattggatgaaatcgctgatccggagctggctttcgagcgcatgatccgcacttaccgtgcaaagggatattccgaaaaatggattcaagaacgacttcgcggcattgatattagaaaaatgctcacagacgagtgggcgcgcaccggcgctacggattcgcgtgacttcgcagaattgacgaatattctcaccaaggcatggtctggaaaaactgtaaaacaatataaatcgttcaaacatcttcacaaggaaaatctccgcgataacatgaccaacatagaactcgccttgaatcagcttgcggaggtttctgcaaccgccctttctaaagccaaaaatccaaagggcatgcgtgagacaaaacatgtcgcacacgaaggtggttcgattgcgggaaatgccaggaaagaactggaatccaaaatcggaaaaagcgttctttcaccgcataacgccgagaacccttatctcttagatgaaaactacgaagaataaataaaaaccgccctgatgttggtgcaccagagcgggaatacatatccgaagatatgcgcatattttgaccaagaatattgtatcatcttcggaacagccttacaatccagaacttttgttctgttttggctgttattattatacaattacataaaggagatgataccgtgtctgaaaaaatcaaacgctgcgctatttacattcgtgtatccacatcagagcagctcgtacatggaaaatcacttgaggctcaaaaagattatctcacttcttatgcaaaggatcatgggatgattcctgtcggagtctatgcagatgaaggtaagacagccaggaaagagctgaaaaagcggaaagcgattcatgccctcctggaggatgtcaaagctggtaaaattgatgtaatcctcttctggcgtctggatcgctggttccgtaacatgtccgatttctacaaggtacaggacatcctagatgaatataaggtttactggatttctgcatctgaaccaggaatcaatatggaaacccgtgacggtcgtctacagttgaatgtcgtactgtcgatcggacaaaatgaagtcgatacgacttctgagcgtatcaaatttgtaaatgaagcttcgatccgtcagaagaaggtcatctttggagaggccaatatgccaagaggatataagatcggtgtggtaaacggccaaaaatgcatggtgaaagatcctgatcaggaagagctagtgaacgctttctttgattactttgaaaaacatcagggaaaacaagctacgctgcgttacatacaaagccattacgatccttccttttcttacagttgccttcgtaccatgctctcaagcgagttttacaaaggaacgtaccgaggaatcccatattgtccttcttatgtttctgaagtacgatgggcacgtttgcagaaaatcagcaaaaagaacattaaaaatacaccatccggacgaatctattatttcactgggatgatccgctgcccggaatgtggacagattctggccggtactggctgtcggtcaattatcaatcgtaagaccggtgaaaaacgagattactgctactaccgttgtaatcgggctatgattgaccgaatctgcacgaacaggcacaaagtaagccagaatcttatagaaacatatctgcttgaaaacctggaaagagagttcgaggaatataagattcgtgtggatgagattcaaaagaaaaacaaacaaaagccaaaagttcgcacagaggaacaaatcgaaaaagaaatgtcccggcttaatcttctctttcagaaagaccgtatcacctgggactattatagcaaagaatacgatgctcttgaatctgaaaaaaacggcttaaaagctattatcatagagccggaaagcgattattcctccgtagaatcacttcttcaaaaagatttccttgccatctaccattctctagccgaagaaaaccgacggactttctggcgtaatattatccggcaaattcacctaaagccggactataccattaactatgttgattttgttcagagtgtctctgtttaaggtgtggatacgtttttccgtatcttacagagaaagtctctgcctaacatgttatccccgtttggcgctgacaaaacaatgaccgccgttctttccaaccaggcagatatcggattcatgggctctgagtcctccatctacacgtataatgagggcgcaaacgattatgtggtgaatttcgcacagcttacccaacgtgcaggaaacttcctcgtatccagggaaccaatcgaagatttctcgtgggaagacctgaaaggaaaatctgtacttggtggcagaaaaggtgggatgccggagatggtattcgagtatattctgaagcaaaatggaatcgatccgcaaaaagacttagcgattgaccagagtattgactttggttccaccgccgcagctttctccggcgggcaaggagatttcactgtagaatttgagccgggtgccaccaccctggagtcttctggcaaaggctatgtagttgcttcccttggaaaagagagcggttatgtaccttatacagccttttccgcaaagaaaagttatattgagaaacatccggatgtgattcagagttttaccaatgcgcttcaaaaaggaatggactatgtcaacagtcatacaccggaagaaatttctaaggtgattcagccacagtttaaggagaatgatctagatacaatcacgacaatcgtttcccggtattatgagcagaaaacatggaaagaagatctgattttcaatcaggacagttttgaattgttacaggatattctggaggacgcagatgagctggattctaggacaccttacggagaccttgttacaacggaattcgcaaaaaaggccgtgaaataaatttttaatacttttttgatattttgaacacacttttttcacatttcaaaggtatgattaaattacaaagtagaaatactttgtgaataaactttttcataactttttccctcagccagtacattccctgtactggctactaaaatgtaaaaaacaggaaagattcctatatccacgaatctttcctattttctattttcatgcgattcccgttccaggttctgtacaaaataccctgcggcaattcctcctatcacatttccaagtgttacgaacaacagtactttcagaacatctccgatggatgtcccaaaattcaaaacatatacggacagataatacatatctgcaatgatatgttcaaatccacagaaaacaaaagcagtgatgaaaagccaaacataaaagatctgagcaaaagtgccctgcttttggcggatacctcctacaaaaaccgcaaaggctacaaacagtgcacagaagagtccaagtattgtcaggctgaccggagagtctgcaagctttggaattacaatctcttcaatccgacctagtattcctgcttcaaatcgtgtgaagtgaatcagaatggccacaagagctgtgccaatcccattgccgatccacgcaatgaacagatcgccgggacgataagagccgttatatgcaaaaagtgggcagactcttgtgaaaagtctgttgtgtaagttcaaaacgagtaaaattcccgttgcaaaaaagagactcgccgcaagtttgtctgaaatgcttaaatataccatagcacccatagcgatataaatacctgccatgatactactgatccatttttctttcataggtatttcctgtccttttcctttgtgatatatgatatgccgcaaaaattgtactcgtatttacaataaaaatcaagtcttatttgtctttttataatcagtctccctgtgatgccgggaaagaatatggaaatctgattaaaaaattgaaaatgatacaataagtcattcgattaccaacagctccggtctgatatattctgtaacctgttccattttacctcatccctcccccccaaatacgtccggcttctctatcaatttatgcaaagccctggatttagaacaacaagcagcacctctttatcagaaatttcacaaaaaaaaccggttttgtcccatgaattgttgacctttatcacacttttgtgttagcataactataggtattcatataatgtgcagagtatgtacagaagtaccctcccggacagtgcatacggatgcggcagcacctttccggaagaaagtaaagaagaaaaggagacgcaaaaatgaaagaatttacttatgtaatcacagatccagaaggaatccatgcaagaccggcaggactgcttgtaaaggccgcagcaggatttaagagtgacatcaagatcgaaaaagacggaaaagcagccaacgcaaagacaattttcggcgtaatgggacttggcgttaagaaagatatggaaatcaaggtgacagcagatggcgaagatgaagcagaagctgtagaagcactccaaaaattttttaatgaaaatttatagagcaagcagaacgcaaatatagagacttcgcaaggggaacgaaaagcttgagaatccgcaggtttccccttgcattttttctcataagtgatatactatacttgttcgcagatatggttcatcggtagaacgctagcttcccaagctggaaaggcgggttcgactcccgttatctgcttacaaaaagccggaaacatggaaagatcagtgtttccggctttttaaggctacctccatcaggcagcctttttgtgttctttcatattcttttttctctagcggtttgcccggtaagcttcatctgcctcccaaacgccgaatccgctttcgtttaagatgtgtgctgctctttgtggttcattcgtctttaaaacggcagatgcgtcctcgccgtttgcgaaagcgtacatatactctacattgataccaccctgcacaagctggtgcatcgctttacttaaagaccctgtatcgtgcggaacccgcagggcaatcaccggcgtcagcatagccatgataccgatttttttcagttcttctcttcccctttccgggtcggaaacaatcatccgaagcatcccgtactccgtggtgtccgcaagactgagcgccacaatattcactccattgcttcccagtgcatcaagcacctcatccagtcttccttctctgttctccagaaaaacagacaactgttgaattgtactcatcctgattcctccttcctacagattacggttgtcaatcactcgcttggcttttccttcgcttctctcgatagtctttggctccaccagtttgactctgacagaaatgccaagagcctgttttaagacgtcgccgatccggtggcggagtgcatccaactgcctgatttcatcagagaagaatttttcatctacttctaccataacggtcaagacgtccatgttgtcctcccggtcaatgatcagcaggtagtgcggaacgacttccccgattccaaagagcgccgtctctacctgagtcgggaatacattgactccccgaatgactttcatatcgtccgtccggcctttgaacttggagattctcggcgtagtccgaccgcatttacatgtctcgtgtgtcatgcttgtcaggtcttttgtccggtaacggatcaacggtacagcttctttatccaatgttgtaaagacaagctctccggtttcaccgtctttgattggctcatgagtaagaggatctaatacttccggatagaagaaatcggaatggatgtgcagtccttcatggtggatacagtccatggcaacgcccggtccactgatctcacagaggccgtaaatatcaaagcagttgatctttaagatctcctcgatcttatttctcatctctaccgtccacggttccgcaccgcacaccgcagccttgatcttcatcttatctactactcctgcttcctgcatagcttccgcaagatgcatggcataggatggagtacaggcaaaggctgtcgcttcaaaatcttccatacacatcaactggcgtttcgtatttcccgctgacatgggaattgccatggcccccaatttctgcgcgccgaaatcaagccccattcctcctgtaaacaggccgtatccataacagacatgaatccgatccttggcggtcagtcctgccattgtcagacaacgtgccacacattctccccagacatccacatccttctgggtgtatgccatcaccgttagtttcccggttgttccggatgtcccctgaactcttacgacctgctcattaggcaccgcaaggaatccaaatggataattgtcccgcagatcgtctttcgtcgtaaatggaagctttgtgatatcctcaatgcttttgatatcccccggttctacaccgagttctttcatcttttccgtgtaaaacgggaccgttccatataccctttttaccagttttcttaatttctctccctggagaattcttcgctcctcttcgctcatgcactcagcatgtggatcgcggattctctcctcccactttttctctgtgatcattcctgttctcctcctacaactcttcatcagagaccagcctgaccccttcttgcaaaagaatctttccggcccggtccatgtcatccgtcgaaaataccatcacaggggcactcccgtcacggatcacaaaagaatagatataattcaggttaatctgtccgtctgccagaatagaaagcattctgttcagattgcctttttcatcttttaactccactccaaccacgtcagtaatccggacgacaaatccaagatgggtcaaagtctctttggctttctgcggattgtccaccaccatccgaagaatcccgaactccggcgtgtcaaaggaagaaacggcccggatattgatctccgcctccacaagctttgatgtgacctccatcagacttcccggtctgttttctacaaatacggatatctgtttcatcttctccctcctactgtgccgccccggtctcaaatgcctttttattgatttcgattgtctttggcggtacagctttctcaatcacctgataccactgatctctggaaaaatccatgtgacgggacgccattcccaggacgatcatattaaacactcgtggatttcccagttttttagcctcctccgtagcattgatggtatagactttatgagtctgttccagcgtctcgatgatatgctccgggtattgtgccgctccgattaccaccggcattggatcaattctccagtcgtttaaaatcattacaccgtccggtttcagaaaatgagcgtacctaagcgcctccaaccgctcaaacgcaatgatcacatctgccaatccttcttccacaataggctccgccacctgatctccgtaacgtacaaaggtcacaacacttcctcctctttgtgccataccgtgtacttcggacagtttcacgtcatatcctgcatccatcgcaagacctccgagaatacgacttgtgaggagggttccctgtccgcccacgccgacaatcatgatattctttgtcttcattattgctcacctgcctttataagccggattgccccaaatttgcataaggattcgcaaagtccgcatccggtacacatcgtatcgtcaattcggatcgtattgtccgcatttcttgtcatggccggacagcctggtttcatacacataccacatttcttacatttgtttggatcagccagatacaccggcttcggagatttatccaaaagtacgcacggcgtccgtgtaataatgacagagacctcatctttcgccgtctcctcccgaatggctttttccagtgcttcaatatcaaacgcattaatgacctgcacatttgctaccccgatagctttgcacagtcccggaatatcgatagcatatgtcggtttcccctgcaaagtctttcctgtagccgcatgatcctgatgtccggtcattccggtcgtagaattatcaagaatcagcactgtgcccgttgcctggttgtagaccatattcatcagagaattgaccccggtatgcaagaaggtggaatccccgataacggccacccagtttttcatgtaatccctcccctttgccttttccattccatgtagactggaaatgctggctcccatacagatggtcgtatccacaacactaagaggtgcaactgctccgagggtataacatccgatatctcccgccgcgtgcatcttcaacttattgagtacataaaagacgcttctgtgcggacagcccgggcagagaatcggaggccgctgcggaacatccgccgcagagtccatcgcaatctcttctctcaaaatggttttcctgatcatgtttgcgctatattcaccctggatcgtaaagatttccttgccgatagccggaatcccccaggatttcacctgctcctcaatgaccgggtccagttcctccacgatatagagtgtctccacccgggaggcgaaatcccggatcgtctgctccggaagtggatgaaccatgccaagcttcagaacggatgcttctggcaacgcctcccgtacatactgatatggaattccgcttgtaatgacaccaatcttcaaatcccgcaattctacccggttaatagccagggtctccgccgccgctttcagctccctgttccgcttttcaatttccacatgccggtatttggcattccctggcatcattacattcttgcgtatatttttctcatacggcttatccggaatctctatccgttctttcaactccaccagtccttgggaatgtgccagtctggtggtaatacggaagatcaccgggcggtcgtactgctcgctcaactcaaatccgattttcacaaactccttcgcttcctcactgtccgacggctccagtaccggcactttggcagcccttgcaatcattcttgtatcctgctcgttctgggagctataaagcccaggatcatccgccaccataaagagtaatcctccattcactcccatataggacaccgtatagagcggatcggatgccacattgagtcccacatgcttcatacacgccatagcacgtacgcccgaaatactggctccgatggccgtctctgccgccactttttcattaggcgcccactcagcgtaaagatcctccttatactggacgaggttttcactgatttctgtgcttggggttcccggatatgcagaagataccttaactcccgcctcataagcgcctcttgcaatcgcttcattcccaagcataatgactttctttgtatctgacatcttataatccatcctttcgtaaatcccggattctttttgcctttccttcgaatctctgaagagaataaggcgctaccagccggatttcggttgcaagaccaagctgagatttcagtcccgccttgatctttttttccagctcacttaaccttccatagctgtcaagcagccggtcatcgatcagctctaccgtgatcgtcattacatccagacggttccttctctccacaaggatttcataatgcggtccgatctcctcgatctttaaaagcacttcctcgatctgtgttggaaaaacattgacgcctcggatcacaagcatatcgtccgcccttcctgaaaggttctccatccgtacggttgttctgccacatttgcacggctcataaaaaagtctcgtcatgtctccggtccggtatctcacaatcggaagcgcttccttaccaaggcaggtcaccacaagctctccccgcgctcccgcaggcaatacttcctctgttttcggatcaatgatctccggaatgaaccagtcttcattaacatgcattccacaaagttccctgcactcgcctgccacacctggtccgcacagttcactcattccatagttctgggtgcagaaaaactgctcgccccacacatgacgcatttcatcccgcatcggctccgtcattccctcacctccgaaaagtccggtccgaagacacagatcctttgccggatccagtcccatcctgcgaacctcctcccctaagtgcagtgcataggacggagtggccaccagaagtgtcacgcccatatcctttaaaaacatgatctgctttttcgtatttccagacgacattggaattacggcagctccgatcttctccagtcctccgtgcagtcccagcgctccggtgaaggtcccgtatccaaaagagagctgtacgatatcttccccgcaggctccgcccatgcaggcgatccttgccacgttactcagccacatctccaaatcattttttgtatatccgacgacggtcggcttacccgtcgtgccggagcttgcgtggaaccgtatcaattcctttttgtccaccgcaaacagccccatcggatagtgttccctaaagtcctttttacttgtaaatgggagtctccgcagatcatccaatgtacgaatatcttccggtctgactcctgatttttccattttttttcgataaggagatacccgtgcatagatgtaagaaacggtctttttcagtttccgaagctgaagcgcctccagttcatctcttggcaacgtctcctcctttgcccatatcatcttttcttcctcctggtctgattaattccggaagcctttcctcttctgcttcatactttttgtatttgccaaggcctttggcaacccgctctttttctcgtcgcttttgtaaagcaaaaagaggatactcctctcaggcttatcctctttattatatcatagtcctttattcatttaaagcattaatccgcaaaatcgaataaggagagctgattggattccggcagatcagaaagaagtcctaagtccgccatcttgtcgatgaccgtcttacttgccttggtccgctgccggaaatcatccttggacagatattttccgtccctggatgcctgttccaccgcctccgccgccttatctcccataccgtcgatactggaaagaggcggcatgagttttccgtcaataatccgaaatttggttgccttcgcccgataaatatcaataggtgtgaattccagccctcttgcgtacatttcctgcacgatcttcatatctttcatcgtatcctgctcttttttacttaagtgatcctgacgactcttatactcccggtagtaataatttagcgtctctttgccctgacacatgatctcgtaggaaaaagcatccgcgcggatcccaaaataagccgcataataagccagcgggtagttcaccttacagtaagcgatcctgtaagccatcataacataagccgccgcatgggctttcgggaacatgtatttgatcttcttgcaggaccagatgtaccagtccggtaccccggcttccttcatggacttctcaaactccggagtcagtcccttcccttttcgcaccttctccataatagtaaaggaaagctcgctgtccatccctttattaatcagataggtcataatatcatcacgggtacagatggccgtagagatcgtcgctttcccctccagaataagagtctgggcattattcagccacacatcggttccgtgagacagtccggaaatccggatcaggtctgaaagcgtcttcggcttcgtatccaccaccatctgaataacaaaatccgtcccaaattccgggatgccaaggcagccaaccggacatccgtcaatatcctccggcgtaatgccaagagccgatgtattggcaaacagcgacatgacatccgggtcgtccaatggaatatctctggcgtcaaagacatgctcttttccatcgtattcattttccatcgcgtccgaattgatgagctcttcgagcgtcttaatcatggtcggatcatcgtgtcccagaatatcgagctttaacaggttgtggtcgatggaatgatagtcaaagtgggttgtgataatgtccgtcgtcatatcgttggccggatgctgtaccggagtaaaggagttgatatcctcaccgtggggaagaacaatgattcctcccgggtgctgccccgtacttctgcggattccagtacatccctgcacgatccggtcaatttcgcaattccgctttctgcttccccgttcctcataataattcttcacaaatccaaaggccgtcttatctgccagggttccgatggtcccggcacggaaggtctgcccctttccaaaaataacctcagtatacttatgcgcgttactttgatagtctccggagaaattcaggtcgatatccggctctttgtttcccttaaatccaaggaatgtctcaaacggaatatcaaatccatccttaatcagaggatgtccgcagaccggacagtccttatctttcatgtcccatccacagcccccggcaaaagctctcacttcctccgaatcaaaatcactgtaatggcaatgcggacaatagtaatgcggacttaagggattgacctccgtgatcccagccatagtagcgacaaaggaagaaccgacggatccacgggatcctaccagatagccgtcctcattggatttccataccagcttctgggctataatatacatcacggcaaatccgttggagataatagagtgaagctctctctccaatcgctccgttaccacatccggaaggttctctccgtacatctcatgcgccttcttataacagatatcccgtagctgctggtcggaattgtcgatgaccgggggacacttatccggccgcaccggagaaatcttctcaatcatgtccgcaatcttattcggattttcaatcacgacttcatgagcctttgccgttcccagataagaaaactcctccatcatctcctccgtcgtatggaggtaaagcggtgcctgctcgtcggcatcagtaaatccttttcctgccataataattctccggtacacctcgtcttccggatcgagaaaatgcacatcgcaggtcgccaccaccggcttttggaacttctcccccagccggacgatctttcggttcaaatcccgtaagtcttcctcgcttcttacattagacacccggtcgctcgcaatcataaagcggttattcccgattggctgaatctcaagataatcgtaaaaatccacaagcttcgcgatctgctcctcggactttccgtttaatactgcctgaaacagctctcccgcctcacaggcgcttccgatgataagcccgtcccggtaccgcaggaattcgctcttcggaatccttggcatcctggaaaaatactggagatgggacatggaaaccagacgatacagattcacacgtccggtctcgttttttgccagaatcaccgcatgatgagatgggagctttctgatggcatcgggattcatggagccaaactggttaagctcctttaatgtatcgatctcccgttctttcagcatctccacaaaacggacgaagatctctgccgtcgccccggcgtcatccaccgcccgatggtggttttccaaagagatattcagtgcctttgccactacatttaatttatatttagaaagggttggcaacaaaaccctggcaagcgctaccgtatccagggagatgaactcccgctcaatctcctggtatctacagttctgctcaatgaaactgacatcaaatccggcattatgggctaccaggacagcatcccctataaagtccagaaacttcggcagcacaacatcgatcgtctccgcatccaccaccatatcatcggtgatactcgtaagctgtgtaatcttaaacggaatcggaatcttgggattgacaaaggtactgaaccgctccgtgataacgcctctctccaccttgaccgccccgatctcaatgatcttgtcctggatcgggctgaaccctgtcgtctccagatcaaagaccacataggtgccatcaagggactgactcccggcacccggagcgatctctgtcaaatcatccaccaggtatgcctccaccccgtagataatcttaaacggatcttctttatcaagagactggatgaaatgattggcgtccgggaacgcctgcactactccatgatctgtaatagcaatagccttatgcccccagtcgtgcgccctcctaacaatgtcattcacctctgacactccgtccatgtcgctcatcttcgtatggcagtgaagctccaccctcttttccggataaagatcctttctcaatacggtaaaatcatggatctttcggatccctgtcacggatccaatcgtcaattcaccatcaaatttgtcgatagtggtgattcccttgacctttaaaaaacttcctttcttgatatcgccaagaagatccggaagctgatcgtttctggcaaacatcttcactgtaatcgtatcggtaaaatcagtaacggcaaacatgaggatcgtcttttcattccggatctccctcgtatcaaagctgataacctttccgcggatcgtgatctcacccatctcgcccaccacctgggaaagctctatcggtgtatcgtcaaagtccctcccgtaaatcatattcggatcgtcggactttctgaaatcccgtctcataatcggctttttcatctcttttccaaaccgcttctctttcggcatcttcggaacaggcggagacttctcctttccagaatcatttccaccattctctgattccccggctttcttctgtttctcttttctgagcgcttcattccgctcaatgatctcatccacttctgcctgaagcaaaagatcgttaaattccagcgcgctcttctttttcggcggcagatagcctacctttaccgaaagcggcacatgaaatcgattgttaaacacttccagcagcaaattgacgatggaatcctttttcccttcggctacgatagaattctgaagctttaaattgagcacaccgtcctcaaactcgcagtccgcatgttcaaacatactacgctccactgcgcttctttgctccaactccagaagaatactttcgtaatattcattcatcagattctccggtgtatactgcccggaaagctgatagctctccagaatctctacctgaattgacgagcggtcaaaaagctgatgcttgatcgaatactccagctcataaatcttttttttctgtaataaatgagtagaaaacaaataaatccgaataaaatctctcgttgaatttgtagcaaccttggtaacccgtacatctttcagaagaaacctgacatcttccggaagatttaatgtcggaaatacctcaaaaaagtcttttcccatatactaagcactctcaatctttgttccagtgtaagagctcctcccgaagcgccggtaaaagctcgtcctcttttagcttctttataatctgcccttttttgatgagaaggccttccccgattccgcccgcaattccaatatctgcttcctttgcttctcccggtccgttgaccacgcaccccatgacggccactttcacatcgtcaaggggaatatcctgtaccatatcttccacctggttggcaagtccgatcagatcaatccgcgtccttccgcaggtcggacaggatactacctcgattcctccttttctaagtcccagcgtcctcaaaataagctttgctgatttgatctcttccaacgggtctccggtcagggacacccgaatcgtattaccgatcccctgatacagaataatcccaagaccgatggaggattttacatttccagaaaggatcgttcccgcctctgtaattcctacatgaagcggatacgcacactgtggcgccaacagctcatgtgccttgacgcacataaggacgtcagatgccttgatgcttacaaccagattgttgtaacccagttcctcgatcatatgtaccttatcaagagcactctccacaagcccctctgcggtcacaccgctgtacttctctacaagatccttctccaaagaaccgctgttgactcccacacggattggcacctggtattcctttgccttgtccacaaccatcttcaccctatcccgaccgccgatgttgcccggattgatccgaatcttatccgctccgttttctatggcagcgatggcaagccggtagtcaaagtgaatatccgccaccagcggaatgtgaatctgtttcttaatctcactaagcgcctttgcggcctccatcgtcggaaccgcacaccggatgatctcgcatcctgccttttccagagcgagaatctggttgaccgtagcccctacatcttccgtcttcgtatttgtcatggactggatggcaaccggatagctgcctccgatctttatatttccaatcggaattactttcgtctgtcttcgcagcatgatcttcctcctttacatgaataaaatcccctctacccaagtcacacgctatatccgtcttcctgtatagaggggaaatcatctatcttttatcaaatatcatctgttcaccgtactcccggtctgtcagtgtcagcgtctggcgctccatgctgtagtcgaacgacgtcacaaacctggaaagcgctgtctgaagcacactctctgtgagctttccatcgtgcttctttaaaatctcttcgatctcacttggctgaagcccctttatcaccagcgtcttctcggatttatccacctgacagtccatcgttacttcaagtcctgacacttcctggagattctgaaacaaaagcttgactttatcatcactttgaattgtcatagtaatattgtcatcctggtactcccaggtccccgcaatcggatttcttgcaaaggaccggatcaggaaatacgctgcaacaataatgatgagaatagtcgccgtccagatcacaatcctgaacaaaaagcttctctctttttcatcatttttggcaattaacatctggataacctccatctttcttcttccattattctaagtaaattataaaatttttatgcacctctgtcaacacgggattcttttcgtctgttttgtttcttttcggcacttttgccataatctgtgtcgcattacggcacagttcctgttttacccatgcatctattgctaaaatgtagccacactaaagataggaggctatatatggggttttcaaaaaggctaaaattacttcggaaaaacgcagacgttactcaggatgagctggcacaatatctccaggtatcccgctccaccattgcaggatacgagacgaaaaaccgacagccagactatgacaaactatatatgattgcacagttttttcatgtcagtaccgattatctcatttccggcagcgacatccgcccggtggaagtgtcaaccgtcgattcatctatgaatgagcggatgctgaaatatcatcttcggacaatctatgccacgttgtcgctcaaatccaagcaggatcttctggaatatgccagactcctcgccatgcgagacgagcattagatggccttccctggatatctctcatcagcatgaaaggaggaatcacctgtttgattcctcctttttttatgttacgacttcagaatctcctcaagagcctcatagagtgtctccatctcctcttcggtcccgatagtgatccgaagatactcccggatctttgactgattccaatgtctgacatagatctgtctctgtcgcagcgcttgaaacagcacttccccatcgtacttcggatgccgtgcgaaaaggaagtttgcgctggaatccggaaattcaaaaccaagggcagccatccttctctttgtccgctctctcgtggcaataatctgacttgtcgtcttctggaagtatgtctcatcctccactgcttttgtcccacaaagaatagcaagagcagacagggtgtaggaattaaacgaatactttacatccagaagccacctgatgagccgttcgtttccaatagcaaacccaatcctcacacctgccatggatctggattttgagaaagtctgcgtaacaagcagattttcatagcggtcaactaaggaaactgccgatggcttcccagcgaaatcgatgtatgcctcatccacgatcaccaccacacccggattctcttttagtatcttctcaatcacatcgagactctcatacagtcctgtaggtgcgttgggattcgcaaggataatgccgccgttttctccgcaatagtcttctgctctgatgtgcatggttccatccagagacgggcatgtatacggaaccctgtaaagctcggcccataccttgtaaaaagagtaggtaatatccggaaacaaaaccggctttccggaattgaaaaatgttaaaaaactcatggccagcacatcgtccgacccaacgcccacaaacacctgctccggccgcacctgataacggctggcaagacattctgtcaacattttgatctccggatcaggatacatccgaagcttctccgggtccatctgatgcagcatctccattgctccaggagccggtgggtatggattttcatttgtattaagtttaatgactttctgacgcggctgctcccccgggacatacggcgtcacgtgtctgatatttgcttccagtcccataggcttactccatttcccggtactccgccgccaatttttcaaacttcgggagagaccggacgatggtgtcgtatgcaacgcagtaggcaagccttacaaatcccggacatccaaaagaactccccggcaccagtaaaagattgtactttttggctcttgtgcaaaattctttctcatcttccactggagatttgacgaagaggtagaaagcaccctccggcttaatacaggaaaatcctgcctttttcagtccttcatagagggtctcccggttccggtcataaaatgcaagatccgctttttcgtttaggcatctcgccactgctttttgctgaagggtcggggcattgacaaagcctaaaattctcgtcgccacattggcagccgagatcacttcctcactgtccgtcacttcatccgggataaccagatatccaattcgctctcccggcaaggacagcgacttactgaatgaatatccgataatcgtattgtcatagtattttgtcaaaaacggcactctggccccaccgtacacaagctccctgtatggttcgtctgagatcagatagatatccgttccatactctttctgcttcgcctccaaaatagcagccagccttttgatggtctcttccccgtaaacaacgccggtcggattgtttggattgttgacaatcaccgcctttgttttgggggatattttttcttcaaactccacaagttttggctgaaatgtctccgtatccggggaaatctccaccagcacaccgtcataattattaacatagcttcggtattctccaaaatacggtgcgaacacaatgacctcatccccaggatttataagtgtctttaatatcacgttcagtcctcccgccgctccgactgtcatagtaatattcttcccttcaaaagatgtgccataccgttcgtttaagtttcttgctaccgcctccctgacgtctgcataaccggcgttactgttcgtataaccatgaagctccaccggatcttcttctaaaaggacgtccttcattgcttttgtcagtgcctccggagccggaatattcggatttccgaggctgaaatcatagacattctccggcccgtaaatctgagccagacggtttccttcctcaaacatcgcacggattgcggagctgttcgctaccatctctttcatcttttctgcaatcattctgatacctccagtacttttgttacgattcctttttcaagcagcattgccggcttgtaggagagcttcgcctttctcagcccctcctccccggcatcgtcctctctgttgacatagcggtatcccttacactcatgctccacaaactgctggttgatcatggtgtatgccccgggcacttctgcaaatgccttttcgatatgcacgacaaaggtgtcctcgcttactggttcccctacagtaaacgcgacaatctcaccatggacacgcagaactcctccccttaaatggagttcacggaacagccgcagggaattgagtgttacgcacatctcacagtttttctcctcgtcatcttcacatccgttttcgtttctccacttgagcgccatctgaaaacattcctccagattatcctcttcaagtggttcataagcccagtcttcataggtagctttgaacttattgatatgattacgctttccatggagctttttcccggaaagcgtgcaaagcttctccgactcgtaaatatagtcagccgcgtccctgtcgtactcaatctgatatcttcccggataccagctatccagaagcgcaaactgcgcttcggaaagtccgtacatcagaaactctccgccatgtttttcacagtacatttccatctgagggatcagctctctgatctcctcctcaggacccgccggccatgcaaatccatagccgcgctcgtcctcctcccggaataagagcgcttttccggtgtcggcaaatttcagattgtaatgtcttccccagagcaacaccccgaaaaatgtccggtcacagcttctttccgggtatttccggaagtactcctcaatgagcttctgatcttctattccgacacgcttaaaattccattcatccatcctgtctctaccttcttttcttttacccaaaatgcaaaagccctacatccgggtcataccggtatagggcatcctgcctgttagttttcctgcatattcgccagcttcgccgcctggtccgcagcgatcagcgaatcgatgatttcatccagatctccgtttaaaatcgtatccagcttgtgaagcgtaagcttaatcctgtggtctgtcacacggccctgcgggaaattgtaagtccggatcttctcggagcggtctccggttccgacctggcttcttctggcctcagtttccgcatcgtgctgcttttcctgctccagctcgtatagtctcgcacgcagtactttcagtgctttatccttattcttgagctgagacttctcatcctgacaggaaataacgattccggtcggaagatgagtcaaacgcacagcagagtccgttgtattgacacactgtcccccattgccggaagcacggaatacgtcgaacttacagtcattcatatcaatctgaacatctacctcttctgcttcaggcatgatggcaacggtaatggttgaagtatggatccgaccgccgctttctgtctccggcacacgctgtacccggtgtacaccactttcgtatttcagtctggagtacgctccctgtccggaaatcataaagaccacttccttgaagcctccgataccattctcgttaagggaaatcatctcacacttccatcttctccgctctgcgtaatgaatatacatccggtaaatctccgccgcaaataaagccgcctcatctcctccggctccggcacggatttcaacaatgacgttcttatcgtcgttcggatcctttggaagaagcagaatcttcatctcatgctccagctcctccaggcgtcttctggcgtcggaaagttcctcctttaaaagctcccgcatttcctcatcgctttcatcttccagcatggacagactgtcgtcgatggtctcattgcatgtcttgtattctttatatgcctccacaatcggaaccaggtcgttctgttctttcatcagactgcgaaaccgtgcctgatcgttgacaacatccggttcctgaagctctcccatgatttcttcaaaacgaatcagcaaatcttccagtttgtcaaacatttgttaattcctcctcattttctcttgctttattgtacacgccgcctactacacggtcaagccctgccagatccttttttacccggatctgctcaaaacctgcctccttaaaaagccctgatacctcttctgcctgatcgtacccgatctcaaagagaaggcttcctccctttcgtaaatacagttcggcctcagagatcatacgacggtaaaaatacagcccgtcctcttttccatccagtgcctcgtatggatcatagagcctcacttcttcctgaagcttttcgatctcctctgtccggatataaggcggattggaaacaatcagatcatagtctccctcaatcttttcaaacagatcacttttaaaaaatgtacatcgttctttcgagataccaagcttctcccgattcatctcggcgactttcagagcgtcccctgagagatccgatccgactccccttcttctttcatccatctttagcagacttaaaaggacgcagcctgatccggtacagacgtccagaatccgctctgccttactctgtctcgccacacggtctgcctcctccacaaggatttccgtatcctgccttggaatcaataccgtctcatccacggcaaaaggatatcccatgaattcctggactcctgtaatgtgctgaagtggaatcctctcccctcttcttttgatgtactcttcatatgctttccgtttggcggaatccatctcttcctgatcccttacataatactgggtttttgtcatccctgtgacatactcaagcagaaaccaggcatccagatctgcttccggaataccggcatgtctaagtatttcttttccccagttccagacttcccgatatgtcataccttctccttttcttcctgatctgccggtccggacgggaaattctccatgagataagcccgccagtcaaaaaccgcctccacagaggcgatggccacttcaatcatggagtcgtccggctctttcgtcgtcagtctctgaagcatcagccccggcttactgaggaaattcaccactggatggtcgctgctgcctgccacacggatgatctcataggagatccctgcaatgatcggtaggagcgcgatccggatcaccacgcgcagaatgtgggactcggtctttacaaagaacaacaacacaatgcccacgatcataacaaacatcaggaagctggttccgcaccgcttgtgctccttcgaactcacccggacattctctaccgtaagcggcagcccgtgctcaatgcagttgatacatttatgctctgctccgtgatactgatagagccgtctgatatcctccatcctggagatcagccggatatacgccacaaaaatcgctatccggatgactccttccagaataattcgtaccagatacgatggaatcaccttacgaaacagattggaaatcccgtatggaagaaccataaaaatcgcaatggcaagtacaaaggacactaccatcacaatcccattcatgattctatccgccctctccttttttcctgcttcctgctctgtcagaatgtcttcctcctcttcaaacccggcagaccaggtgagcgtcctcattccaagaaccatagaatcaataaattgaaaaatcccccggacaaacggaatctttaccagactatggtaattcccgactatacttcgatagtcctcccggtcgatctcaatctccccgtcaggctttcgcaccgccacggcatagcggtctttgtgcttcatcatcacaccctccaaaaccgcctgtcctcctatatttgatgacttcataagtaatacctctttctatctggcttcaggcttttaccggaatgaaaaagagctgagatgtaaaaacctcagccctgtacttctgaatcttatttgctttcgattccgtatttcttgttaaacttatcaacacggccacgagcctgagttgctttctgctgtcctgtgtagaatggatggcatttggagcagatttcaacgtggatatcttcctttgtggaacctgttacaaatgtattcccacagttgcatgttacagtagcctgatgatatactggatggattccttctttcatgttttcacctcttcttgcttttattgtctcacacagaattctctgtgactaattgtctcttaaacagcggattcattgtatcacacctgtattgcttttgcaagcattttttaaataaacttcatttttttcactttctgaaccagttcagagttttgcttcgtctgctgaaacagattaagaatcgtatccacagcctcgtcagatttcatgccgtttaaaccacgccgcatgatatagactgcatcctgctcatcctgggtaagaagaagatcttcccgtcttgtcccggatttcggaatatcgatggccgggaacattctcttttcggagagcctgcgatccagaacaagctccatattgccggttcctttgaattcctcatagatgacatcatccatcttgcttccggtatccacaagggctgtcgcaagaattgtcagacttccgccctctctcatatttctggctgctccgaaaaaacgtttcggcatatgcagtgcggccggatccagacctccggagagggtacgtccgctcggcggcacgaccaagttgtatgctcttgccagtctcgtgatactgtccagaaggatgataacgtcctttttgtgctccacaagacgcttcgcgcgctcgataagcatctcggacacccgcttatgatgctccggcagctcgtcaaaagtagagtagatgacttccacattcttaccgcggatcgtctccttgatatccgttacctcttccgggcgttcgtcaatcaaaagcacaagaagatgcatttccggattatttcgcaaaacagagagcgctacttcctttaataaggtcgtctttccggctttcggcggggaaacgatcattcctctttgtcctttcccgatcggagaaagaagatccacaatccgcatcgatgtactgctgcgctcattttccagtttcagtctttcatttggaaaaatcggcgtcatatcttcgaagttacgtctttttaccgcaatcgccggcggcagtccgttgatctttgttacaaataacagagcgctgaatttctcagactgagtcttgattctggtgtttccggaaacaatgtctcctgtctttaatccgaatttacgaatctgggatggagacacatagacatcattctcccccggaagataattttcacagcggataaatccataaccgtctggaaggacttccagaatcccgtgggcggtgataccgctgtccaagtctgcaagctccagtacagcgcttttctccgttcttccctcatcccgttgcgtatgctcgtgctcacgccgtacttctcttacagattccgttttttcggtctctgtctcttccgtgttttgcgtttttctatcctcttcaaggagccggtcaatcagctctgactttttcagtgttgatgttcctttaagtcccctcgcctttgctacgtctttgagtactgccagtgaaagtgtttcatatttttctttcatatccatcatattctgttttcctttctattccggtctgtggggaaaatagtctgactagacctatgtgacttaatgcatcaagtatacatcacatttttaaaattgaaaagtcttttttcaaaatttaattgcacccccgttttatcaatggtatgatggaagggatgaacaaaaatgacagtacattaaaatagagaagaaaaggggatcaaaatggctgaaaatcatacattggaaaaagcattgaacatgcatgaaatctggaatggtaagatcgagacaacggcaaaggcgcatgtccggtcacgggaggatcttgcggtagcatacaccccgggcgtcgcggagccctgtaaggtcatcgccaaagacccggaggccgcatacaaatatacaatgaaagccaataccgtggcggttgtctcagacggaagcgcagttcttggacttggcaacatcggtgccctggccgccatgccggtaatggagggaaaggctgtcctcttcaaggaattcggaggggttaacgctgtaccgatctgtcttgacactcaggatacggaggagatcatccgtacggttgtcaatcttgctcctgcttttggcgggatcaacctggaggatatttccgcgccaagatgttttgaggtcgaggagcgtttaaaggagcttcttgacattccggtcttccacgacgaccagcacgggactgctatcgtcgtcctggccggagttatcaatgcactgaaagtcgtaggaaagacaaaggagaattgccgtgtagtcgtaaacggtgccggctcggccggagttgccatcacaaaacttcttctgacttacggattttcctacattacgatgtgtgatatcaacggtacgatctgccgggattcaaaacatctcaactggatgcagcagaaaatggccgaggttacaaacccggatcagctccacggcacgctcgctgacgcactaaaaggtgcggatattttcatcggggtatccgctccgaacatcgttaccaaagagatggtggcgtctatgaacagcgacgcgatcctcttcgccatggcaaacccggtaccggagatcatgccggatctggcaaaagaagcaggcgccagagtggtcgggacaggccggagtgacttcccgaaccaggtcaacaatgttatcgctttcccaggtattttccgaggtgctttagaaggacgtgcttctcagatcaccgaggagatgaagctggcagccgccaatgccatcgcgtcacttataggcgagaaccaattaagcgacaccaatatcctgccggaagcttttgacccacgtgtagctgatgctgtaagcgccgccatcaaggccctgatccgttaggatggagagaagaatgtgctggggcgagaaacgctactattctctcgattactatctgaaagagacatttcacgagaagctttataaactctccttaaatgcaggctgtacctgtcccaaccgggacggtacctgcggaagcagaggctgtatcttctgcagccggggcggaagcggcgactttgccgcaagccctttcctttccattgcggaacagcttcgatcagaaaaagcgcggatcgcttccaaataccgaggccacgcctacattgcctattttcaggcttataccaatacatacggttccgtgaacgttctggaacgtacctttttccaggctattgaagatccggaggtgaaggtgctttccatcgccacccggccggactgtctcccacctgagattcttaatcttcttgagagactgaaccggatcaagccagtctggattgagcttggattacagacgattcatacgtccactgccgcctacattcgacggggctatccgctttctgtatttgaggaggcagtgcgaactcttcgtgccatcggaatttccgtgatcgtccatacgatcttatatctgcctggtgaatcgaaagcccagatgctggagacaatagaatatctgaaccttcaagagatccagggcatcaagctgcagcttctccacgttcttagggataccgatctatataacgattatcaaagatatcctttcccgctcccgtccatggaagaatatctggattttctcgggacatgcctgtgtgcgctgcggcccgacattgtcgtccaccgtctgaccggtgacggccccaagccccttcttgtggctccgctctggaccagtaacaagcggctggtgctcaatcaaatgggaaaggtgttcaaagaaaaggatatctggcagggaaaaacctgtcgtactctttagaaaggaagtgtacactatgtcagaaacatttactctgtataagctgatcatcctgtacatgctcagtaaagtggattttcctcttaccaacgcacagatttccgattttattctcggaaagggatatacgacctacttcactctccagaaggcgctctccgagcttacggagtccggcctgatccgtgaggaaacaacgcacaaccgaacactgtatcatctgacggaggaaggcgacgaatccatctgtttctttgaaaacaagatctccgacgccatcaaaaaggacatcagcgactttttcatcgagaagaaattttccctcaaaaatgaggtttctgtcaaatctgactattatcggaatacaaacggggaattttccgttcactgccaggtaatcgaacacgctatgccgctcatcgatctgaccgtcaccgtcccgtcacgtgaggaggccgagaccatggctgccaactggaatgcacgaaaccaggagatttatgcttatattatgacgcatctgctgtaataactgccctaaatacaaaagatgtaaactgggattggaagaagtctccattttaaaaaggagcggctccgacagcgactgacaagctgtggtaccgcccctttttatgttcttttctatgttcgaatatattgaagccactctttgatttctttttctttccccaaatctcccggatgataaaagacagatcccttgatctcgtccggcagatactgctgttttacatagtggttcggataatcatgggcataccggtacccaacgccatgacccagattctcgtgtcctccataatgggcatcctggagatgtgcaggtacagacgtcctttttgtctggacgctctccattgctttggagatcgccattaccgccgcattgctcttcggtgcggacgccacgtagagcactgcctgggagagaataatctgggcctccggcatcccgatccgctccacagcctgggccgcggataccgccaccgtaagtgccatgggatcggcatttcctacatcctcggaggcacagatcataattctgcgggcaataaagcggatatcctcccctgcgtagagcatctttgccagataatagaccgccgcatccggatcagatccccgcatacttttgatgaatgcggaaattgtgtcgtaatgattgtctccatccttatcatagcgtacaacccgcttctgaatacattcggagacgacctcaagcgtcaggtgaatcatcccgtctacactcctcttcgtcgtcaatacggcaagttccaccgcattcagagcaagtcttgcgtctcctcccgccatatcagccagaaactgaagggcatccgcttcgatctcggcgtgatagcttcccattccttttttctcatcgtataccgcccgccggatcaacacttcgatttcctccagagaaagtggctttaattcaaagaccgtagatctggaaatcaacgcccggtttacctcaaaatacggattctccgtcgtagctccgatcagaatcaccgtcccatcctccacaaatgggagcaggtaatcctgctgccctttatgaaatctgtgaatctcatcaataaacaatatcgtcttctgctggtacatcccccgtgtccgcttggcttcctcaacgaccgcttccatatccttcttcccagccaccgtggcattgatctggcagaattttgcgctggtggcatttgcgatcaccttggcgagggtcgtctttcccgttcccgggggaccataaaaaatgacagaggttaatttatccgccttaatcgcccggtaaagcagcttgtccttcccgataatgtgctgctgtcctacgacttcttccagggtctccggtctcagccttgaagccagaggtgactctgtttccttttgcttctctctcgcgtattcaaataaatccatctcttcgtttcctccttatgcacatccactgagatttcgaatcacttctcctgcgatcatcagtcctgctaccggcggcacaaaagagacactcccagggacagaccgcctttcgcccttatcttcctcgctggccgcctcagaaatatcgatgggtttttctttggaataaagaacagtaagaccttcgattcctcgttttttcagctcttttctcatcacacggcagagcgggcagacggatgtattgcggatatcatcaatctcaaagagctccggatggagcttgtttcctgtccccatgctactgatgagagagatcccgtgctccttcgcataacgggccaccgccagcttggctgtcaccgtgtcgatagcgtccacgatataatccggacggatggcaaacacctgcttcagattgtcttctagcacaaactcctcgtacgttgtcaccgaaatttccggtgaaatatcagcaatcttcgcctccataacctttgtcttatattgcccgatggtgctgtgaagggcaatcgactggcggttgatatttgtcagcgacaccgtatcgtgatccacaagcacaaggtgtcctaccccgcttcttgccagcgcctcgatacaatgagatcctaccccgcccacaccaagcacggtaacggtcgcctctttcagcctgtccagtgcttcttttcccaataataattctgtccttgaaaactcatacagcatgtttcttcccgttccttcatctatcataaattctatgattcgtccacaattaatccataatcagttcatcgactgtgacgaactgatatccctccttctgtagggcatcaatgatctgaagccctgcttctactgaggtgccgtaacagtcatgtaataagataataccattttcttctgccctcgtcactacctttctgacgatttccccggtacttttcgtacaccagtccagcggatcaatatcccatttgaccggaatcaactccacatcctttagtgtttcttccctcagttccccataaggtggacggatataggtgactttctctcctgtgatcccttcgatcacttcgtttgtctttttgatctcttctttttcagtctccatatccacccttgtcagctccacatggtgatatgtgtggttcccgatgagatgtccctccttatacatccgtaaaatcagctctggatgttcctctgcttcctttccgatcacaaaaaagctcgcctttaccccccgttccttaagtccgtccagaagctgcggggtataggtgccatccgggccgtcgtcaaaggtaatggcgatccttttctcctctttctttgccacatcgctgatactctccatcgtcttcttcgtgttctgccacataccagtcagacagaccgccgcaatcaaaaggatctccccgatcaatttccaccatcttgttttctgtttcactcgatacgccactctccttttctctcctgtaaatgtattccgaagaaaagacagatagaacccggagtactagcgcccttgcctgcactccgggttccggatggatctttattatttctttttcttctttctgacgctgtagccaaatgtaccgatcttctttcccagtcccaggtattctccatgggaataggccagaagtcctgttttgttcagctcaaactttccattttcattcatgtacctgctgcttacctgcacacccgtcacatccgctaaaaacatatcatgtgttcccagacgcagaatcttgcgcactttgcactcgatgttgaccgggcactccgcaatggcaggagcatactgaagagagacggccgcttttctcgtcagacgtgtctcctcccacttatccacatctcttccggatcggaccccgcagaaatctgtagctcttgcaagcttctccgtcgtcaggttgacgacaaattctcctgtttcctcgatcatatggtgggaaaaccgtcccggacggaccgaaatgtaaagcatgggcggatccgagcagaccgtcccggtccacgcaaccgtaagaatattgtcctttcctgatttatccgcacagcttaccatgacagccggaagcggataaagcatattccccggtttaaaaatctctttctcactcatttctctctcctctactgctgcatctcgctgaccagcgttgggataagctgcttctttctggatactacaccgtttaaaatgatatcctctgtatcctcggaaagctcaaaggcatccatcacagtctctctagcattcccaccgctgcatagcagttctgtggactgttctacaatatttgtcaacataaaaaaaaccatatcaagtccgctttccttgagcacttctaccagctttggacagatcttttctttgatctcctccagttcctctttgtccatagaattgatctgacctacaccgaatgtcagctcattgacgtggaattccttaaaatcctgaaagcagatttctgcaacagatttattagcaagattgctgcccgctttaaacatctctttcgcaaactccacaacgtcgatctgcgcgatctttgccagcgtccgtgcagttgcttcgtccatcggcgtacaggtcggcgactggaataaaagcgtatccgaaaggatggcagcgcacagaagtcccgcaatctctttgggcggcttgatctgattttcctggtacatctgataaataatcgtcgctgtacagccaagcggctggttccggaaataaaccggccccatcgtctccaaattgccaattctgtgatgatcgatgatttccaggatctccgcctcctcaataccgtccaccgcctgggttttttcattgtgatccactaaaacgacctgcttgcgctttggctttaacaatctccgtctggagatgaatccggtaaatcttcctttcttgtcaataacaggaaaatcccggtagcgctttttcgtcatcacttccttgacctcttccagatagtcatttacgtggaatgtggtcaggtgatcccgcgtcataaaatgctttaccggaatactctggttaatcaggcgggccgtcgtaaaggtgtcaaacggagtactgatgataacaatatcccgctcagacgccagctttttgatcgtccttgacacctccgctccttggcagatcaccagacagcttgcgtccatctcaatggcgcagagttgggactcatagcggtttcccacaatcaccaaatcatccggttcaataaaattctccatcatatccggggaggacgcggcaatcacgactttccccttaatgaagtaagcgtgctcatttcccgtaatgatctccccgcttaaagtatccttgatactccggtactgtgttctggcttcggacaacagatgactgtcgtggagctccatgtaggaattagcgatatcgccaatcgtgataatcccttccagcttttgatcttttaacaccggaagggttcggatactattctctttcatcatagcccaggcttcctttacagacgcctgactggatactccgtcaattttgcggatatccacatctttaagctgctggaaaacattctgtaaaagcgccggttcctggacatgaaactgattcagcacaaagagcgtctcctcggagacggttcccgcccgctttgccacataattctttcctgtgacccgccttttcagctccgcataagcgatagcagaacagatcgaatccgtgtccggatttttatgtcctaccacatatacctttctgtctttctgattatctgacatatgatttttatttcctcccacaaaaatctgccgtatcggcagatcatttccttgatataaacctagattatcatttttttgatgccccgccaactgtttttttctgatttcgccaaaataatcctccgctgtgccgcaaactatgatatactggctaaagaaaacacgaaaaaggggtgtatcaccaatgaatgaagaattagaaacaacgacaccggaaatggagacccggacagagtgcatgaaagattatgaagatcaatttgatatgtctgatccatggcatattgtacagagatatctggacgaaaagacgaacctcaccctgaaggtggaaggtgttgtcaacggcggagtcatcgtcaaggtagagggccttcgcggattcattccagcctcccgcctgtctctttcctatattgaagacctcgaatcttacctcctcaaggagatcactgtccgcgtcatcgaggtggatccggaagaacaccggcttgtgctttccgcacgggaaatcttaaaggaaaaagacgcaaaagagcgctccgcacgcatctccagtatccaggttggaactgtgatggacggtgtagtagagtctatccagtcctacggtgctttcgtccgttttgaggatggactctccggtctggttcatgtttcccagatctgtgaaaagcgtatcaagactccggctgacgtcttaaagatcggtgatccggtcaaagtaaaggtcattggaatcaaagatggaaagttgagtctgagcatcaaggcactccatgaagaaaaggacgaggaagacgaaaatctccacgtagagattccgaaatctgaagagatcgggacaaatcttggcgatctgttcaaaaatattcggttataggaaaagaaaaggcggacgccccgggatcttccggatgctgcatccgccttttctttttactgtgctctcctcgcttacgttctaccgttcttctttttctatgcgctccagatcggagatccaaaccgccgcacaggcgtcgcttggcatcctccagtctcctctcggcgagagggcgacggttcctactttcggtccgtccggcagacaggaacgcttaaactgctgggagaaaaatctccagtaaaacttcttcagccacttcaggattgtttcatcgtcataacttccagcaaacgctttcttcgcgatccggtagatcttggatggctcgtacccgaaacgtagcacatagtaaagataaaaatcatgcagttcgtaaggtcccaccagatcctccgtcttctgggcaatctctccctcttttggcggaagcagctccggacttaccggagtgtccagcacatcgagaagtacctcccgaagctcccggtccctgcacgtatccgcataatattgaacaagatgacgcaccagtgtcttcggtacagaagcatttactccatacatggacatatggtcaccgttgtaggttgcccatccaagggcaagctccgacatatccccggttccgatgacgagacctccagatttattggcaagatccatcagcacctgagtacgctccctggcctgtccgttttcgtaggtcacactatgatcctcaaggtcctggccgatatcccggaaatgcactgtcaccgcctcccggatcggaacctccatcaaagtagctccaagcttttcggacatccggcaggcattctgatatgtgcggtcagtcgtcccaaagcacggcatcgtcaccgcatggatattggctcttggaattcttgccatgtcgaaggctttcgctgtcactagaagtgcaagcgtggagtccagccctccggaaattcctacgaccgcactggtagtctttgtatgaagaagccgctttttcagtcccatggcctgaatcatcaaaatctcctcacatctgtctgctctctcacgctcattttgaggaacaaaaggcgccggcgaaaattccctcgtcaaaacagtcttctcctcctttgcggagaagaacacagccggcagtgtcttgtgcagcgccgagcggaaagtcgtattcttccgacgctccgacaacaaccttcgaatatcaatctcactgtagatcgtctcgttgacaaaccgtccggacgattttaaaatcgtcccattttccgcaatcagattgtgtccgccaaaaacgacatccgtggtagactccccttctcccgcattggcatagacgtaacccgcgatcaatcttgccgactgcccggaaatcagtccttcccggtaacggtcctttccgatcgtctcgtcacttgcagaacagtttacaagaatgagcgctccttccagcgccgcccggatacttggcggaaccggtgaccagacgtcctcacagatctctgccgacacaaccagatctttggtctcccgggaaacaaacagaatttgggggccaaacggtactctcttcccgtcaaaagcgatctctcttgtcacatccggtcccggcgtaaactgacgcatctcataaaactctccataatttggcaggaacgtcttggtcgtaaacccaaggatcatgcctttattcagtgccgccgccgtattatacagctctccatccaccgcaatgggacatcctacaaaaacaagcgcctccagatctctcgtcgcttcagtgatcttcaaaagaccgccctttgccgtttccaggagagcatcctgggtaaacaaatccccacaggtgtatccggtcacacacagctctggaaagacgatgatcctggcgccgtttcccgcggcctcccgcattcttttgataatttcttccgtattaaacgctacgtctgccacacggatatcaggcgtagctgccgccactttgataaagccctgtttcatgccctattcctcttttccatttgatttttcagtctgactgatgctcctagtttttctttgcatggtgtaaaagcttttccagctcttccacggtaaaggtatatgccgtattacagaaatgacatttgacctcaatgtccttcccttccgcaatcatctctttgatgtccctctccccgatacttacgatcgctttctcgatcttctcttttgaacagtcgcatgcaaatgctgtcggaagcgtatccgtgatctcaatatccataccttttaatacttcctgaaggagagactccggtgtatgaccctgctctaaaagcgcggtcacagaatgaatcttactgatattttcctctagccggacgagtacctgctcctccacaaacggcatgacctgtacgatgaacccacctgcacagcgtactgtattatccttttccatcaaaacacccagtcccacagaagacggtacctgctcggaattggcgaaatagtatgtcaggtcatccccgatctctccggtctggagaatcgtctgacctatatacggctctttcagtcccatatctttgatgacatttaagataccaagacccaatgctccgcctacatccagcttgccgttctttggcgggagcatcacgtccgggttttctgcgtagcccttgacgttcgctttgctgtccgctgtcacggtaagtccctggatcggcccgtcgcacttgatctggatcgtcagtacgtccgtatcgtttttcatcatacttcccatcataccgcccgcagtcagaagacgtcccagtgccgctgttgccaccgggctcgtattatggtatcttcttgccgtttccaccaattctgtggtggacgcggcaaaagcacggatctgactgcctgccgctgttgctcttacaatataatctttcatcgcttttcctcgtttctttttatttcctgtattgtattctgtccggcatttttatctggacacttcgcagcacttccggcactctcttgctactacgcagacgcgggcgctatcttcccccggttcttctctcgtgaaatcatcatataaggcgaccagttcaagacccgcctccctcagtgcatctgccacctctgaaacagtgtaccccctttgaaagtgtgtctcctcaaacttccggtacagctctccctcccgcacaaaaatcgtcagatcgtattcattgatccgctcttggagatcatagtagttttcccagataaagctgcactcctcgcgattctccgcaatggtcgtatccccgagaagttctctgtacttatactccgtattgaagtcaaacaggaagagtcctcccggatccagataattattcaccagggaaaagactttcacaagatcccccggttctgtcaggtaattcacggaatcgcaggcactgataaccgcccggaccgtgccgtaaagctcgaacttacgcatatcctgaagaagatataggatgtcctgtccggacgcggcgcgcttttccatcgccagatccagcatctcctcggaattgtccaccccgatcatatcatagccctgctccgcaagcaattctgtcatactcccggttccgcatccaagatcgagaacgatcccgtccatgatcccatgctcccgcagaatctccttataatagtccgtccactcttcgtatggaacgttgtccataaaggtgtcatacacctgtgcaaatcccgtatatgcctccatccaatcatctcctgccgactataaatccggcttattatagcacgattttgccagttttaaaaggggcaaaatcctccggactttttgttatccggaggatctgtctgatttccttattcgattacatgaatccagccttttggtgcttcgatgcgtcccatctggattccggtcagtgtatcgtaaagctgctttagtaccggccccatctcatccataccgcttgcaaagcagatctccttgccgtgatccacgatctttcctaccggggaaacgacagcagccgtaccgcaaagaccacattccgaaaattccggtacttcctcaagcggcacttccctctcttctgtctccaatccgagatattcttttgccacatagagcagggagcgccttgtgatagacggaagaatcgaggaggactttggcgttacgatctttttatcctttgtcacaaagacaaagttggctccacctgtctcttctaccttcgtcctggtagctgcgtccagatacatattttccgcatagccttcttcgtgtgccgttacaatagcatgaagactcatagcgtaattgagacccgccttgatgtgtccagtgccattcggcgccgctctgtcaaagtcagataccttgatcgtgatcggctttgccccgcctttaaaatatggtccgaccggagtggtcaaaatacgaaactgatactcttttgccggactgacgccgatcaccggactggacccgagcatgtacggccggacataaagggtcgcaccagaaccaaacggaggcacccacgctgcatttgctttgacagtctgtgtgacggcatcgaggaaacgatctttcggaaacgccggcatctccagcctttttgcggaatccatcatacgctcggcatttaagtccggacgaaacgtgacgattcttccatcctctgtcgtgtaggctttcagcccctcaaacacagtctgtgcgtactggaacacacccgcacattcattcagcaccacattggcgtctgatgtcagacttccatcgtcccattttccgtctttatagttggaaacatatctcttatccgtctgaatatattcaaaccccagatttgaccagtctaaatttttctttttcatttcgatccactcccatcttattatcttatttttctagtataaaactgtttgaaagaaaattcaagagtgcgctctgtttttatgtagcgattcagccgtgcaatctgaagcaatctggtctgtagcaagcttgcaaatctgagccgtatggccgaatcgttacctttatcgctcagccatactgatggcttcgattccaacgcttccgccacgcacaacttccacatcccgaaattcctctcgtaaaagcttcaccacagcatcgttttttgtggctgtctggagaaactccagaagcatactgtccttaccgtagtcaatcacttctgcccgaaaagtctgtgcaatctgaaagagctctgtcttatcctccaatgtacatttacggatcttgacatagagtatctctttcatgcagacggatagatccgtaaaatcaatgaccttaatgacttccaccatgcgatttaactgctttttgatctgttcaaatgtctcctcgtcacagtgagtctctattgtcatcctggagattgtcggatcttctgtccgtcctactgtaaggctctccagattataacactttgccgaaaacagcccggaaatcttagaaagcacaccaatctggttttccacataaagagagatccatctttttttcaacattccattcatctgtccatcctccttatcttagcagtccatcagcatttcctgtaatgttccgtttggctttaccatcgggtatacgacttcttccggatcaatgagaaattcgatcaaggtcggcacctttgtctcggcggctgctgcccgaagcgccgtttccacgtcttcctttttctttacacggatgccctttgctccgtagctctcggcaagctttacaaaatccggcgtatatttcggaagctcctcatcacctctccgaagtgcggcccctgcaagaaggttcgtcatggcgtatcgtttcccgtagaagagcttctgccactgacgcaccatcccaaggtaagtattgttaagaacgcagactatgatcggaagctcctctaacactgctgtcgcaaattcctgaatgttcatctgcatcccgccgtccccggaaatgacaataaccggtttatctggattgccgatcttggctccgataccgcccggaaatccgtatcccatcgttccaagtcctccggacatgaacagacgtttcttttccgtaatctcagaatactgagccgcaaacatttgatgctgtcccacatcggttacgaggataccctcctcgaacacacagttaattccctctataatatcttgaggcaacaaattgttgccttttcttttcatttgcagcggatgttctttactccacccgacgatcgcctgcatccattctattgtatccttctcctcggcatactccagcatcttctcaatcgcctctttggcatccgctacgattggtacatccacgtggatatttttagagatagaagctgtatcaatatcaatatggacaatctttgcgtttggagcaaaggcgtgcagctttcctgtaatccggtcattgaatctcgttccgatggagaagaggacatcgcactcttctaccgccatattggccgcgtaggcaccgtgcattccgagatttgccacatagtaaggatgatttgtcggaatggctcctcttcccataaccgtcgtcacaaccgggatcttcgtcttttccactaattttgtaaacgcttcgttggctcctgcgatattgacgccgcctcctgccagaaacagtggctttttcgcatggtttaaaagcttgaccgctctcttaagctgtccgatatgaacgtttgtatttggcttatagcctcggatattgacttctttcggatattccgaagatccaagctctcccatcacatcttttggcagatctacaagcactggtcctggcttcccgctgcgtgcaatgtaaaatgcctccttgatgatcctgcccagttcttccctgcggtgtaccgtcaccccatactttgtaatactccttgtgattcctacgatatccacctcctgaaacgcatcgtttccaatcagatgacgcgccacctgcccggtaaagcatacaagaggtacgctgtcataattggccgtggcaagccctgtcaccaggttcgttgctcccggtccgcttgtcaccagacagacgccgacttttccagtggatcttgcataggcatcggcctcgtgaacaagtgcctgctcatgtcttgggagaataaccttaatgtctccctgtttgtaaagctcgtcgctgatatctattgtacatgcaccgggatagccaaagagcgtatccaccccttcctcttttaaagcctttaccagaagcttatttccactgatctttctcatgccgtttcctccttctacatttctttccccaactccgccatgcttccgagtcagacagcgactctgccatacgtatccgtctgcaatataaaaaatcctgtttggcaggattctccgcctgcggcgggccgcttgagcggcagcttctactccgccgcagtgcgatccgtgcggagcgttttttatttcataggaacgcagtccctatgaaataaaaaagacgccccaagcatatgcttagggcgaataaatccgtgataccacctaacttcagaatctctctgcactcaaccagtacttccatactgtctccgataacgccggaaccacgtcggagcctactcacatcttacttcctctatggaataaaaccctttcagtccgctgctcgtgggccagttcccacccgccttcacggaaacttccaccatccgtctcctctctttgcatccggtcgcgaggtactcctcccagtcactacatttctctgtctcgttaaagtaattactgccattatacgaggtggcaggatcagttgtcaagctttttctcggcctgttttcttctatatctcgtaaaaacatattccaagtcaaaatatgtctgctcctcgctctcatcttccagctcccattctggatccgcatccaaatccgggaaataggtatccgccgcatagctgtgacggatccttgtgatatacgcctccttgcagtatggaagcagcatccggtaaatgctctcccctccgatgacatagatggattcctccggaaaagactttaattgctccagaagctcttctaaactgtgaacgacaacggcgtctttcacctgatagctttcatcccttgacaagacaatattcgttctctttttcaaaggctgtccccccggaaaactctccatcgtctttcttcccatgacaacaacattaccctttgtcatctcccggaaaaacttcatatcagcaggaatactcaccagaagcttatttcggtttccaatcgcccaattttcatctaccgcaacaatcagattcatctttgtctcctccatttcctaaaccgcaatcggaatatccttgatctgcggacctgtcacgtaatcgtccaggcgtacatcgtccggtgtaaaatcatagaaatctttcacatccggattcagccagaacttcggtgccagatgctgttctctttgaatcaactcctgcacaagcgggatatggcggtcgtaaatatgagcgtccgcaatcacatggacaaacgcccccacctgcatatcgcacacctgtgccaacatatgcatcaacactgagtattggcagacattccagttgttagccgccagcacatcctgggaacgctggtttaaaataccgtttaagacaagtttatcgctttccggctgttttgtcacattaaatgtcatgctgtacgcgcacggatacagattcatctcatgcagatcctggtgtacatagatattggtcagaatccgtctgctgtacggattgtgctttagatcgtagatgacccggtccacctgatccatcatgccctccttgtactggtgctttacctgcatctggtatccgtaagcctttccgatagatccgtccggatccgcccaactgtcccaaatatggggctttaagtcgtgaatattattggacttgcgctgccagatccagagcatctcatcggtacagctcttgatcccggttctcctaagggtcagcgccggaaattctttggagagatcgtatcggtttaccaccgcgaactgtttgattgtgtaggccggggcgccatcctcccatttcgggcgtaccttctctccctccgtactcgtaccgttatcgataatgtctttgcacatacggacaaatatctgatctgcataactcatcttctttcctccattctgagatgtttattgcgatttcatcaaggcaaaaacttttgccctggctagtgtctttgctacgaggtaaaaaagcactgcctctaccggcaccatcactaattgctttaacagtctggccggaagaagcgccacaaaagaatttccgtacatgacggtaagccagtacgtattcaggcaagtgttgacaaggatagcaaccaccactttcgccgccacgatccgccagacggtaagcggcttcttatacaggatcagcccgtaaagaatacctcctgccactgcactgaccgtaaatccggggaaaaaagcccccacaggcttcaccagatatttcaggatgtcagctactccagctacaattccaccgacagacggtccaaacaacatggccgcaatctcatttggcaggaaagaaaatccgatctttaaaaaatcagtcacctgcaccgtcccaaaaatcgccaaaacaaccgccagcgccagaagcatggcgatcactgccatcgtatggctgtctcttagctccgaaagtgattcccggaacatgtctcgtagtttcttacttttttccataaaaatatacctcctttgcagtagtccttttgccacgcacagcagatattttgctctctgtctatgtgcagcagcgggatgcaaaatatgtaccgcaagaatactcttttcgtccaccggcaactccccgtccgtatggcacttaacgcacatatttctactctgcctgttcgtttcgtttttgattatagcacgaactctttttatcgtaaagacattttctgacgattttcccgccacctccatatcgcttcccgtctttactctctggttttagtattccatggcttcttcccgtgtcatccagaaatggatcccgtgggtagaatctttccagcggtcgtcggtaaaagcatccgcatagacccactctccccttcggtagacgaagttttcatctaccaaagaccatgcctcgtcaaactcctgcctacagtcaaagcttttaatcgtgagaacctttgccttgtcacagcggcaggccgccccggtggcagaacttcttttggcatccgccggaatcaaaagctggacaatccggtcataaacacatttcttgtaggctacaaaggcgcctgtttccgggcagcgcattgcatacccctgcgttgtctcatccatcttggcttgtgtcagatctgcattttccagagcacaaagccgaatatccgcctctctaaaatcagcatagcaaaggatacatcctctaagatccgctccccgcaaattagctccccgaaaatcagctccggtaaagtcacactcccggaaccgggagttcacaagattcgccttcttaaaatccgcgctccgaaaactgattgcagtgaaatctccccactccagattctgtccatgcaaatctgatccgtccatcttcctttttttccacctgatcttctccatcctttttccctctttcttccactctatcctctgttcggctcttccatcctcgcatccctgtttcccgaactaatacagaaagccaaaatttttccaaaaaagttgttgacattttcttttccttatagtatcataatttttgttccgagtgaacagcttttgataagcgacagtggctcagttggtagagtacgaccttgccaaggtcggggtcgcgggttcgagccccgtctgtcgctcttctttttctaatttcatagtgtatgcgacagtggctcagttggtagagtacgaccttgccaaggtcggggtcgcgggttcgagccccgtctgtcgctcttcaacacggttctttggaaccgtgtttttttgtagaaaactggttcctataaaataaaaaacgctccgccgtaggcggagaatcctgcaaagcaggattctatgcttctccctcggatactttgtccgatttcagcacaccgattcccaactcttccagctgcttcacagcaacctcggacggagcttcgagcatcagatccgatgcgtcctttacttttggaaacgcgatgacatcacggatactgtccgcctttgccatcagcataacaagacggtccagcccatatgccagtccggcgtgcggcggcactccgtatttgaacgcattcagcaggaatccgaactgctcttgggcctcctcttttgtaaatcctatgacttcaaacatctttgtctgaatgtcattctggtgaatccggacgcttcctccgccgatttccgtaccgtttaatacgatatcgtaagctttggcgcggactcttcccggatcactgtccaaatactggagatcttcttccatcggcatggtaaacggatgatgcattgccacgaaacgattctcatcctcgttccactccagaagcgggaactccgttacccagagaaagttgtactggctcttgtcaagaagatcaagctgtcttgcaatctccagacgcaggtttccaagcacatcccatacaaccttatttttgtccgccgcaaaaagcagaatatcccccggctgtccatccatagcctgaatgagagcagacagctcctcttctgtcataaatttcgcaaacgaagatttcacacttccatcctcagcaatcgaaaggtaggcaagccctttcgctccatattctttggcaaagtccacaagtttatcgattttcttacgcggcattgccccctgccctttggcattgattcctctgacgcttccaccctgatccaatgctcctgtaaagacgccgaatccacagccctttaccacttcactgacattgataagttccatgccaaaccgggtatccggcttgtcagaaccaaaacggtccattgcttcctgccaggttattttcggaatcggcagggtaacatctacatccagtacttccttgaacacatgcgcaagaagtctttcattaacatccaggacatcgtctacatccacaaaggaaagctccatatcgatctgggtaaactccggctgacgatctgcccggagatcttcatcacgatagcatctggcaagctggaaatagcgatcgcatccggaacacattaacaactgttttaatgtctgaggggactgtggaagcgcataaaaactgcccgggtggacacggcttggcaccaggtaatctctggctccttccggtgtactcttcaccagagtcggcgtctcaatctccagaaatccttcgtctgccaaaaactgtcttgtcagcgtcgccacctggctcctcataaggagattcctttgcatgtccggtcttctcagatcaaggaaacggtatttcagacgcagttcttctttggtcttactgtcctcttcgaccgggaatggcggggtctcagactcggagagaacccgaatctccctgacacggacctcaatctctccggtaaccaggttttcattgactgctccggaacgtgcttccacagttccgaccgccgcaatgacgaactcacttctaagcttcgcggctttctcaaatccctcctcatcgatgctgccgttctcaaatattaactgcaggatgccggaacggtctcttaaatccacaaaaataatcccgcctttgtttctgttcttctgtacccatcccataacggtgaccgtttccccgatgtttcctttcgtaagctcggcgcaccggtgcgttcttttcaggcccttcattgattctgccatatctcttcctccatctcttttgctctattcctcgccctgcggcgcaaattcccgtacaaaacactctttcacatcggtatatccgtcctgtgcaagctggtctttctggaatttcttatttttcttcatattggaaaccagtatctgatatccctttgcccgctcttccttcgcaagggctaaaatccgggtcacaccttcagaaggcatccctttttcaatcagataggctttcttctctttctttgtcggaatctggtagccgctctctaaaagcagaaggacaatgcgttcaaatccgatggagaatccacaggccggggtatcctgtcccgtaaactttccgatcatcttatcgtaacgtccgccgcctcccacagatccaccgaactcgtccatggaaatttcaaaaatcgtaccggtgtagtaggacattccccgaacaagcgtcggatcgaagcgcatcgcaaagtccgcttccttcgtctcctccacggtggagataatcgtctcaagcccctctgccacttccggctccagatacccggcaagcttttctttcaggtagtggattccctccagatcgttcgtcacttctttaaataaggtcaggtaggtatctacgacgttctccttatatcccgcttcttttaactccatctccaccccttccggaccgatcttatccatcttgtccagaatgatgaaaacctcatcaaagctctccttagcaaacccgctgtaaccagccatagcctttaaaatctgtctgtcattaatacggatcgtaaaatgtctgaaatccagctttccgagcaaagtgctggtagcaaggatcagctctatctccgcaagattagacggctcgcccagaatatcgatatcgcactgcataaactggcggtatcttcctctctgcggacggtctgctctccagacatttccaacctggagcgccttaaatggggacggcagctcgtttgcgtggttagcataataacgggacagtggtagtgtcaaatcatagcgcagccctccatctaccagatctgactccgtctttgctgtctccagattcagctttgccccacgctttaagatcttaaagatcaactgctcgttctctcctccctgtttactgagaagattttcgatatgctccacacatggagtctcaatcgcggaaaatccaaaggtacggtatgtatccttaatcatctgtatcacatagtcccggatctccatctcccgtgggagcatgtcattcattccggtgaccggttttttctttaatgccatagccattctccttttcgctctatcatctcatcgatccgggcgatgtactcgtctacctgcttcacattttcaatgcggatcagattcgtcatcttgtgctttttgctacccggcatctcgacggctttggggaggacaatcttcgtagaagcgcctgctccggccgccacaatggactgcttttcctccataattagtatattgtaaattcccgctttgtcaacctctgcatatccgacattctcaaaattccccgccatatttttctgtcggtacagataatacggcacaagccccatctcgcctgcacagcggtaagccgcgtcaatcattgcggtaagatccccggcgcttgctgtatgcccggtaaatccctccccgcttctttgctcctgccgaagcctggaagcacgcttgatggcaagagcatgtaccgtcaggctgtccgggccaagtgcctggacctttgtcagggtgtcttccatatcctccggcgtctccccaggaagacctgcaatcagatccatattgatattgtcaaatccaagttctcttgccacacgaaatgtcgtaatcacatcctccactgtatgccgtcttccaaccagatccagtgtcttttgctgcatcgtctgcgggttgacggaaatccgcccaatcccgtgccttttgagcactttaagcttctccctcgtaatactgtccggacggcctgcctccacggtaagctccagaagatgctcataggaaaactgtttttccagatgggtgaaaagtctgtccaactgatcagctctaagagatgttggagtcccaccgccaaggtagatcgtattgagctttttctccctggaaactgcagcaatataggacagttccttacagagggcttccagatacgcatctgtcttctccagatactgactgatcgggtaggatgtaaaagaacaatacgaacaggtcgtcggacagaatggtatcccaatatacaggctgtatccattctcatagtctaaccgggaaagaagccttttttcccgcttggcaatgtcaagccctagtttggctttctccccggaaacaaagtgctcctttgtgatccagtccaaaatcctgtcatccggtactccctcttctaatttctgcatcagcatcttagtcgggcgcacaccggtcagactcccccagggcaggctctttttcgtggctctgcacagcttttcataaagcgaacggactgccagatgttttttctctcctctgtccatctgcaaaagctctgttttctcgccggccagcgtgacgcaaaaacaagaatcacagtctgattcaattctgatctgtgactcttgctcctcgtctacctgctgttcgatttcttcgtccggataaaaagctttcaacagatgatacgcatcataagtatataaagtatcattacatgtcagcttcattatgatttctcctacacatgtcttctcagaaatggattgtatttcttctcttcaccgatcgtcgtagcatccatatgtcccggcaggactttcgtctcatccggcagcggcaaaagcttatcctcgatgccccgcacaagatctgacatactgccgccctcaaaatccgtccgtccaaccgaatggtggaacagtgtgtcgccactgaacaaaatcccttccgacgcaacataatagcagactccccccggtgtatgtccaggtgtgaaaaacacctggaaatcgtatcccgcaagccgaagaatcttcccgtcctgtacatagaccgcctcagaaaaagtatagcccttcgtatagatatcggactggttccagtgggcgtcagtaatcaatcccgcttctttctctcccacatagaccggcacatcataaaccttgcggaaaccatcgatccccataatatggtcaaaatggccgtgagtcaggaggactgccttcatggaaagtccctcctcctcaataaagtgcatcaacttctttgtacaggcggccggatccacaagtacggcctcctttgtagtctcattgtacgcaacatatgtgtttgtgccgataatccctgttacaaacgtctctatcttcatttggtcctctttccggcctctagcctgttgtcctttctatatcaatcacattttcaatctgtctgagcttgccgatcagacgtcccatctcttctttgcctcttacgacaaagcccatctccacagtagaaacgcccttcttacttgtgcggacattcatcgtcttaatatcgatctctgtttccgtaaagactctcgagatctccatcagcgtcccgggcttatcctcgacatacatcttgatctccgcaaaatacttgccttcggaagcctcatcagcatctgcctcccactccaccggaatcagtcttgcccgctccctctccgtcaggtgcaggacgttgatacagtccgtccgatggatcgtaagccccctgcctctcgtcacaaaacccacaatctcatctcccggaagtggattacagcacctggaaaaccgtaccgccatgtcgtcaatccctttgacgatgattccgctcttggatttggcaatgtgaactacattctttgatgcctccgctactttctccagaacagcctcatccgtaatctcctgtctgtgatctttattgtactcatccgcaaggcggtttacaatctggccttctttgagtcctccatgcccgatagccgccaggacagaatcccagtccttaaaaccatatttctgctgtacgatctgctgatattttggcttcagcagattgccctgttccaatcctttggacttacagtaggagaccagcatctctttcccacgaatgatattttcttccttaaactgcttcttaaaccattggttgatcttattcttcgcctgggtgctcttgacaatattgagccagtcccggcttggtcctttcgaattctgggaggtcaggatctcgattctgtctccgttctggattttataatccactttcacaagctttccattcactcttgcacctaccattttattacctaccgcactgtggatggcataggcaaagtcaatcggtgtcgacccgtttggtaaatttttaacgtcgccgtttggcgtgaagcaatagacatcttcagcaaacagatccaggtctcccttgattaggcttaaaaactcccggttatccgacatatctttctgccagtccagaatctggcggagccagttcagcttctcctcctcctgcgccttgatattctttttcccgtcgttggactccttatacttccagtgagccgcaataccatactctgctgtcttgtgcatctctttcgtccggatctggatctcaaacggctgtcctacagtactcatcagtgtggtgtgaagtgactgatacatattgggctttggcatggcaatgtagtccttaaagcgtccaggtaccggcgtatacatctcatggatcactcccagggccgcataacaatccttaactgtattcacgatgatacgcaccgcaaaaagatcgtaaatctgatccacggtcttatcctggtttaccatctttttataaatgctgaagaaatgcttcacacggccattgacttctgcctgaatattggcgttctccatatgctgggagacttcttttacaatctgtgccacaaactcttcccgctcagtctttctctcgttgatctgctgcaccaggtcgtaaaaaacctccgggtgcaaatatttcaacgccagatcatcaagctcggtcttgaccttggaaataccaagtctctgggcaatgggagagtagatatccattgtctcccttgccttttccttttgtttttccggtttcataaactggagtgtccgcatattatgaagccggtccgccagcttgatgataataacccggatatcctttgccatagcaaggaacatcttccttaaattctccgcctgcatctccagcttatccgaggaataagaaagctgccctaacttggtaacgccatccaccaaaagggccacatcctccccgaaatctctggcaatatcctccttcgtctcttcggtatcctctaccacgtcgtgcaggatgccggcagcgattgtctccttatccatctccaactgtgcaaggataattccaacccacagggggtgaatgatatatgcctccccggattttctgaactgatttgcatgtgccttactcgccagctcatacgctttctctatcatcgaaacatctgccgatggatgatatttacgaatatgcccgatcagatactggtacagttcatccggatcttgataatcttcaggctctttgaccgcatgaccgtctacaatccgcagtccctggcggacttccgtcgtcacttcttccggtctgattttttctgccatatcaatcccctccttttcctgtttttctcccgctttactctcaaatatcatgtcgttttttggaatatattttttagtatatcattatttcaaaaaagtgtaaagcaaagcaagaatccatttttcgtatgacctggccgtatccttctctttttacagtattaccgataatccaaaatggtaatctgcaatgtctttttccccatatattcattgacgcccggataataagtgacatccatgaaaagatcctgtcctcttccggaaagaagctgctctctggcgtctgggccgtatttttctgaaagacaggagaaaaacgactccatctctccgaaaaagacagcttccataatagtatgatcctcgtccatcacttccagcttgagaacgttttgatgtttcccgagcagtctgccccgcaaaagggaaagcttcctctgtgcaaagaccggtttggtattcccttttccaaacggttccagaagcgaaagttccttgataaacgattccgtcacctcacaaagcggaagctgcatatcaatgactatcttctccgtcagctcccgttcggtcaatgttgtctggtcattgagtgcttttcgcaaaaagaaaatgttctcttccggcagggaaagccccgccgcaagccggtgccccccgaaacgggtgagaagattcctgcacttgcacagttcgtcatacatatgatatccctcaatggaacgaccggaacctttggctccttcctcagcccttgtaaggacgtacaccggcttatagtagcgctccctcagacgacctgccacaatccccgcaatgctctcatgacattccggcagataaacgaccagcaccttttcttctttcagtccggttgtctccacctggatcacagcttctttgaccgcctcctcggtcagatttttccggctgtcatttagggcttttaagtctcccgccagaagatctgcctccttctgcgtaccggcacacagaagttccagcgcccgttttgcggtatcgagacgtccgcccgcattgatgcatggaccgatgacaaagccgatatggtaggctgacaggcactccttgttgactccggtacattccatcaacgcacgcagccccagattctttgttcttttcagcatctcgagcccctgcgcgacgaaaatccggttctcatccctcagatccataacatccccgacggtagcgatggctacattctccatcagataatccacatcctccgggtcttttcccatcacgttgtacaaagcctcgatgagcttataggctactgctgctccgcaaagccccttgtacggatacaggcagtcctcccgtttgatatccaccaccgcgtctgcgggaggaatctggaacaccctcgtcccatcttccttttcttcatagggtacctcgtgatggtcggtaacaatgatggacatccccatgctttttccgtaggcaatctcattcttcgccgcaatcccgttatcacatgtaataatcgtatcgatatcatcatccaaagcccggtcgatcaaatcaatattcagcccgtagccatcccggatccggtctggaatatcataatccacccgggctccaaggccggtaagcccttccagaagaatatatgtggcattgacgccatcaatgtcataatccccgataatgcggatgctctgaccttctgtgatcttctctttcaacaaatcgacagccttgtccatgtctttcatcagcatcccgtcgtacagatccgcaatggttccgttcaggtaccggtccaccgcttcctccccgataatatcccggttgcggatcagtgccgccgtccttggatgaatatgaaaccgctcccctattttcgtaaaattgccgccctttctgagcagtacccagtttttcatctgtattcctccactgaaaagcaaaaggatgccgcaagatcctggtgatccatcctgccgcatccctttattcgctctatttctttttccctgtttccgtttttacaacctctttcttctttccgactttggtcttcatcacataccagagcgcacctgtaatgcacaccgaagagtacgcgccacagatgatacccgccatcagaggcagggcgaactctctgaccgaagcaactccaaagaggaacaggaaaaataccatgataaaggtcgtaagagaggtgtagatacttcttgtcagcgtcagtgtaatacatctgtttacaagctcggcaagagcttctttcttctttcgtacctttaattcttcacggatacggtcgaaaatcacaatcgtcgcattgatcgagtatccgacgatggtcagcatacaggcgataaaggtgcttcccacggtaattctggatactgcataaaacgcaagtaccaccagtacatcgtgtactaaggccgccaccgcactggttgcaaaccggatatccttaaaccggagccagatgtaaagaagcatacagatggtggaaatcacaaccgcaatcaccgcatcttgtctcatctccgcactgatggtagagctgatactggaataggtaatttccgaatccttgatttcaaacttatctgccagagcctggtttaatgcctctctttgctgaaggctcaaagcctttgttctgatgataatctgattactttcctttactttctgtgtctgtacttccgaatctcctgttgcctcctcgataaccggaacaatctcggactcgatctcggaaatgctgtagtcttcatggaacgctacattcgtggacgtaccaccctgaaactccagactgtagttcagcataccgttccctttgatctggtgatatcccatcacgccaaatccaaccacgatgaccgccagagagatggcaaaacagagcgctttcttgctgaggaaattgaccggctttctctctttccatttctttgcatagaatttctcatcccggattcccactgcatagaaggagtatacaatcatccttgtaattaccagagccgtaaacatcgatatgacgataccgagcgccagtgtctgtgcaaatccacgaactgtaccggaaccacggaaccaaagtactgcagctgcaatcaatgtcgtaacattaccgtccacaatggctgagagcgctttatggaagccgccttttaaggcgtttcgcacactctttcccgcggaaatctcctccttcactctggcgaaaatgatgacgtttgcatccaccgccatgccaatggaaagaatgataccggcaattcccggtaaagacaacgtaatatcaaatgcatttagcagcatcagcacaagccctgtgtaaatcaaaagtgcaagtcccgaagcaagtcccggaagcagatagacgatcatcataaagaggatcacaaccgcaagtccgacggcacccgcatacaagcttgtgctgatcgcctcttcaccgagctgggctccctctacctgggaattcagctcttccagctccagggaaagtccgccgatccggatagaggccgccaggttctctgcttcttcaaaagttgccataccgtcaatatatgctgttcctccggtgatcgcctcattcactcttggggaactgatcgtctccccatcataaataatggaaatctggtttcctatgttctccttcgtagcctcggcaaacttcttggatccctctttattgagctggagctctaccatatactcgttggctcctgtagtctgatcctggccgctttttgcctcagcagtcttgatatcgcttcccgtaagtaccgtttccccgtcagacgtctggaactcaagagttcccggctgaccgagttcttccaggatttcattggcgtccgatacacccggtatggaaatactgatccgtctgtcgccttcctgatatacactcgcctccgtgctgtaggtctccacacgtttttgcagcttgtagaccgtatccctcatatcttcatccgacgggttcttctccttcgtctgataggtgatactgaccccgccggccagatccaggccaagtttgatatttttcatagccccactgtgggatccgccccatccgaaactcactgtataggccaagagtgctatcatcagaatcgtcccaagaagtcctgcgatccctctgcttttcttcatatcttacacccccttctctttaagcctgccggctctcttccccgatgtccgccaaagcagcttttatcataatcgcacactctactctttttctctccatctcacatccgatatcataagcatcatgtaaggttccctcgaaatggtaggagtttgccatacagccgccgctgcaataaaatctggcgaagcagttacggcatttctccttggagtatacattgcagcaccggaactcatccgcaatctcaggctttgtaatgccatcgtctacatttcccatcaggaagtcctcatcccctacaaactggtgacatggatagagatctccccacggcgttactgccaggtactctgtgccggacccacatccggaaagacgtttggcaatacaaggacctccttccagatcgatcataaaatgaaagaaattgaatccttttccttccttttctctctggatcatatagcttgcaagcttatcgtattcctcgaaaatctgcggcaaatcttccttgcgaatagcataaggatctgtctcatcccctaccaccggctcaatggacatctgctgaaatcccagatctacgaaatggcgtacgtcctcggaaaagtccagattctgtctggtaaacgttccccggacataatatttctgctggttcctgctctttgcaagcttctggaatttcggaacaatcaaatcatagcttccttttccattgcgaaatggccgcatcctatcattgatctcccgtcttccatccagacttaacaccacattgtccatctcctgattgataaactcctggacctcgtcgttcaaaagcacgccgtttgtggtaacagtaaatcggaaatgcttgtcgtgaatcttctcctgctctcttccgtatgccaccaggtctttgacaacctgccagttcatcagaggctcgccgccaaagaaatctacttccaggtttcttctgctgccggaattggcgatcaggaaatccagtgctttctttccgacctcaaaagacataagcgcccgtcttccgtggtattctccctcttcggcgaaacagtacttgcaagccaggttgcagtcatgcgcgatgtggaggcagagcgccttcactactgtctttcttttcattacgtcctggatgcaggcttcgtgcgtatccggtgcaaaaagctgtccggcctcggtaagctcggcaagatcgtcaagaaccgtgtcaatttcctccggctcatatgtattttcaaactgtgcttttattgcttctctcgttttggccgtctgtattgtgctggccgtctgctccggatggatcgcatttaaggcagcgattacatcgtatcccatctggtctacgacatgcacgcacccactgttgacatccagaacaatattgtatccgttattctggtactggtgaatcactatcggtacccctttcttttttctttgaacatcaagagacagcgaccaaaaagccgctgtctttgtacccttcgtttataagtcctgactgcctatttcttctgctcgcaggtctggtttcctactgtacaggaagtcttacatgctgactggcaggatgtctggcattctccgcatccgcccttcttcatcgtgttgtttaaggtctgtgtatttaatgttttaatgtgtttcatcctgatttcctccttctgccttttgctagaagatattatagcatagcctccttctttttaaaagcccttttttcgcaatctcacggatgacctttgcaggccgtttgatggcgccgcacatcttttgttctctatgacaacataccgcccaacatcccacctgcggcgcacagtaccaatgtcgtcacgatctgcatcacatctccctgaagggtgtgatatacgccaaaggagaccagtaccagcagaaggaaatacaaaatcccaagcatgagcccccagataaatttgcggactttctgaagctttccgattaaaaatcctccggcaaatgcggagacaacataaattccggtaatccctgccgtcactttgcccttatccagattcagtttataaagcagcactgccagcaccaagagcaggattccggtaatgatataagataccagaagtgcctgaaaaatccgcataacccctgatttttgtccctttactctcatcgcatcctccttgtcctgtttctaagactattgtatgatgcgggcttgcgctttatgactatgcttccatctgacttccgagaaatgtggcagcacactgggcaagcttctgacagatttccttggatgctcccttctcctcttcctgccacaaaaaaacgacagcgccgatcacatcgcctcccgtaagaaccgggcacaccaggctctcaaggtagtccagattcttatatttcagcaaaggaaccatccccttttctctcacccctttttgtaccatccggcgttcctccagaagtcccacgaactcctctgaaatctcctggtccgctacatcctttttccctgccccggatgcagcgatcaccttttccatgtctgtgatacacgtcagcactcccgatgcctgggaaaggctctccgcataattctgtgcaaatgtataaatttctccaagcggggaatattttttcagaatcacttctccatcttttcctgtaaaaatctctaaaggcgtgccctcccgaatccccagtgtccttcggatttcctttggcacgacgactcttccaagatcatcgattcttcttacaattccggttgctttcatatcggtcttgttccctccatttcacaatataaccgttattttccacggttccacataaggctagtatccgcaaaaggaaaaattttattctgtttgcactttttcttaagagatagtaaaatagaaaaaaacacgaggaggtcgagcagacgatgagtaaaattgacgacgtaagaaaagaaatggtcgttgccatgaaagccggcgacaaagcaagaaaagagacgctctcttctcttcttgccgctctcaaaaataaagctatcgacaaacgggaggatctgacagccgaggaagaggtgcaggttgtattaaaggagatcaagcagacgaaagagactctggagatgaccccggcggaccgcgctgagatcatcgccgagtgcagggctcgcatcgcagtcctcgaagagtttgcgccaaagatgatggatgaagaagagatcaaaactgtgatctcctccgtcctctccgatctggagctgacaacgccgactgcaaaagataaaggaaaaataatgaaagagctgatgccgaaggtaaaaggaaaagccgacgggaagctcgtaaatgagctggtcagcacgttctttgtataacgccttcatcagatgataaccataaaagaagcagcctactcggctgcttcctctgcgttatctgtattgtccgtattctcggaatcgtctgtattctcttcatccgtactgtctttactagtagagttatccgtactgtcggagtcatcctccgctttcttcaccgcaaccccttgttcgttaaagtcgatttttttccagacgtccttattttccttaatctttgtatcgtctttccatccctcgacgatctcattgtaacagtcattctcccgttcggagatgatctgctgcttcttattatctgtggctgtctgatcaaatgtggaagtcacctttgccacatagtatccggaatcggtctcgatcacgtctgtcacctgtcctgcatccagcttgtcagccgcagcgatgacttcctcgttcggagacgtcgtctcagaatcaaaggtcagatccagcgcggaggtttcctggtcttttgctgcctgctcaaaatccgtgcctcccttaactgcatctaagaatgtatctgcttttgtcttagcctcttcctttgtatcggatgtgctctcagagtcctcgctctttgactcctcggaataagtaaatgccacatactgcatcgctttctgagccgcctcttcatcggaaaccttgcggtctacatcctttaacatctctgtccgcatcttctgctggatcgtaaacaattgaagaacttcttccaccgtctctttatcccctgagatcacttcccggacattttcgccgttcgcttctacgaaagcatctgctgcctccccgattgcttttttctcgtcctctgtcagggaaacatcataatcccccacgtgttcatttaaaagataaagctcctccagagactgcataattgtctctttcgccgactcttcataagtcgtatcgtcgtcgacttttgtcgtccacatattttctcccagcatggaactgtaataagtctcatacattgcctgctgatatcttgcaaagaaatttgctatattccctttaatctctgttttacctactgtcgcaacaacgtcgctgtccttaatcgtctcttgcccgcagcctgccattgcccccgccgctatcacggcagtcagaaggacaactgccaaacgctttttcataatatcaaaagcctccttcgtatttctaactaccctattatatccggtttcccttttacaatcaatgtttttatgtcatttaacagatttttcacgacttccaggatatccggatctttctctttgcgatttcgctttttctgctcgtaaaggaaatatggaggtgcgtcatttttgaatagcaattctccttttcttcgctccagaagtttgggaatctcctgaacctgcacttttgccttttcatacatcgtgattttgagtgtgctgcctttttgctcgatggccgtcacatacacggagtgggcaagagccttgatccgtgcaatcaagatgagtttctgtactttcttaggaatatccccgaagcggtcgatgagctcttccatcatatcgtccatctcgtcttctgtactgatgagggcaatccgcttgtaaatatcgagtttttggtactcgtccggaatataggaggccggaataaatgcatccacattcaggtcgatcgtcgtggtaaagctctccacctcatcctgatctataccttgtttcatgcctttaactgcctcgtttaacattttacagtagagatcataccctactgcctccatgtggccatgctgtgcttctccgagaagatttcctgctccccgtatttccagatccctcatggcaatcttaaatcccgatcccagatcggtaaactcccgaatcgccgccagacgtttctccgccacctcccgtaaaagccggtctctccgataaaggagaaaagcataggccatcctgttggaccgtcctacacggccccgaagctggtataactgagaaagccccagtttgtccgcgtcgtggataatcatcgtattgacattagaaatatcaagcccggtctcaataatggttgtagagacgagcacgtcgatatccccattgatgaaatcatacatgatcctttccaactgatgctcccgcatctgcccgtgagcgtaagccacatttgcctccggaatcaggctctggatacgggctgtgatctccgcaatgtcttttaccttattataaacataatagacctgcccctgtctggagagttcccgcacgatggcctcccgtaccatctcatcctgatattccatgacatacgtctggatcggcatcctgtccatcggtgcttcctccagcacgctcatatcccgaattccgatgaggctcatgtggagggttcgtggaatcggggtagccgtcagtgtcagaacgtccacattttcccggagcttttttatcttctccttgtgttgaacaccaaaacgctgctcctcgtcaatcaccagaagtcccagatctttaaacgtcacatcctgacttaaaatccggtgggtccccacaagaatatccacctgccctttcatcagatcttccagtgtcttcttctgctgagcaggcgtccggaaacggcacatcagatctaccctgaccggaaaatccttcattctctgcacaagtgtgttgtaatgctgctgtgccagaatggtggtcggcacgagaaatgcaacctgcttattctcctgtacagccttaaaagcggctcggatcgccacctcagtctttccaaatcccacatctccgcagatcagacgatccataatcttatggctttccatatcctttttcgtgtcctcgatggccgccaactggtcatccgtctcctcaaagggaaacatctcttcaaactctttttgccatacagtatccggctcgtaggcatagccgtccttttcctgacgcgtcgcataaagctctacgagatctcttgcaatctcctgtacggcttttcgtacccgcgtcttcgtcctctcccagtcctggcctcccagccggttcaacttgggcttctttgcatccgcggaagcgtacttttggatcagatccatctgggtggccggaatataaagattgccgcccccggcgtaggagattttcatataatccttctcaatccggtccacttcaatcttctcgattccctgatagataccaaggccatgattttcgtgtaccacatagtcccccggctttaaatccgtaaaactctggatcttctccccctcatagatctttctgcgcttctttctcttcttttttccgaagatatccgtctcagagataacggtgaatttcagcatcggatattcataacccactgccacgtggccgtaggagacaaaaatctcccccggctttaccaggcggtttggatcttcatcataaaagctgtttaaatcataatcccgcagatcttctgccaatctcctggctcttgtccgggagccactcagaaggatcacccggtatccatttcgcttcagccgcttcaaatcccttgtcaggacttcaaaactgctgttatatgggttgacattctttgccaggatactgtaagtctcccgcacatggaattccttcagttttccttccagcgcggtaaacccaatactatgatagctatttaaaagccccacaatctcacgcaccggaaacatccggatctcatcctcctctgtctttgaggtccgctccgcttcctctcttctttcctgcgcctctttgacctcctcctcgattgtcagccctctctcatataaccttgcaggctcatccaaaaacagaagtgtctcctccggctgaaaatactgcaaaaaagaaactccttgttttccggagactgtatccgatgccgggtagaaagtgatctcctcccggttttccacagaccgctgcgtctccacgtcaaacgtccggatggagtcgatctcgtcatcccagaattcaatccgcaccggcatctcttctgtcagggggtacacgtccaaaatcccacctcgtacagcaaactgccctggtccttcaatctggatttctctgtcgtatcccatcttggaaagtctgacctttaattcctccaggtccgacatgtctcccacgcgcagggtaaagatctgtccattgatgccggacggaggacggacgccgtccatcaaagcatcgattgtcgtcaccaccgtgaccttctcctcctcccgaagcgcccgaatcacttccatcctcttctgagtcagatattttccccggatatccgcacggtaaaacagaaaatcctttgccgggtagaaaaagaccccggcatccagaaactggtattcctccaagatctcctttgccttttcctcatcctgcacaacataaagcacccgtctgtcctccctggcaagggcataggcgaggtgtcctttctgtgatccggtacttccggcaatctgaatcatccccggttcccggtattttgtcttctgaatagtatcaaactccgcaagctccaaaagaggcgccgtaaaagccttcatcgtgtcttactcccttccatcaacctttgcggttaaactgattcatcgcctcacagacgtcaccatgtaaagccatcctcacggcctgtaccgccttttcgtaggcttcctccatcttctctttgtcctctccttcaaaatgtcccagcacataatccgccagatcgtagccccttggcttttctccgactccgatcttgatccgcaaaaacgcgtcatgtcccagatgggagatgatgctcttgataccattatgtccgccggcgcttccttttttgcggatccggagctgtcccacatccaggctgatatcgtcataaatgacaatcagatccgtttcctcgtccaccttataatagtccaccaactcccggatactctctccgctcagattcataaaggtctgaggctttgcgagtatcactctgaagccgtcgatcacacccctgccgatgagcgcccggtgctttctcgtgtccactgctatatggtattcctccgcaattttgtctatgacatcaaaccctacattgtgcctggtcccttcgtattttaatcccggatttcctaatcctacgattataaacatgactttctacctctcttttttcgtatctttttattttaccgtaaaaaccctcttttggcaacgctgcatacaacgtacacaaaaatcttcgttttcaaacaagtttgaactcagattttttgtgactttgtgcatggctgaactgttactttcatatatagtataaaggcaacatctcactgtactgccagatttgacatcttaccgaaaggagagcttttgacttatgagttccaaaacaaaaatcgtcgtatttcacatgaaggagatcatctacaccgccatttttgccgcccttgggatcctcctcatcctgcttctgctctttatgttcctgcccggacatacaaaaggaaagcagacatccaaagactataagcccggaatctacactgccagcatgacactcaataatacacctctggaagtggaggtgtccgtggacaaaaaccatatcaattcgatccggtttgccaacctggacgaaagcgtggaaacgatgtatccccttgtccagccggccatggaagaaatcgccggacagattatcaagtcccagtcgacagacaagatcaaagccggcgaggatgactcctatacatccaatctcatcttggatacaatccagaaggcactgaaaaaagccgaggcagactgatatgctgccccggcttttcctatccttccacgaccagatactgtcctcccggaagtgcgaacacttcggatgcgtcctcaatctccccaagtgtcataccgtccacatccgctccgtactcatccagataatctcgaacctcttctaaagaatccagtacgactgccatacagtcctccagaaaagcctccgcctcctccggcgtctccgccaccggctcgtcaaatagctgggattgttctcttaagaacacttccaaacattcttcactaaatctctccatgcgtctcctccttgcccttttgtactgtcaccaccgaaatcagctcttccgggtgatcgatcaccacatgggcccctgtctcatacagaagctctttggaacgaaatccccaactgacaccgacagttttaacttttgcattgtttccggtgtgcatatccacatccgaatctccgatgtaaacacactcctcccgtgtgatgcccgcgcgttccagaatggaaagcactgccgccggatccggctttctcggaatcccttccttttgtccctgcacggcatcaaagaaatgatctccgaaaaaggttcgtaccacatccctcgtttggccgtccggcttattggaaagaactgccagaaagaccccttctttctttaatcgctcaagcatctctttgattccatcatatggctttgcgtgataggtgcaatattttgcaaaaacatcgctgtaaactgccatggcctcttccatacgggacatctcttcatccccacacgcccgcagggtacactccaaaagctttctagcgccgtttcccacaaacctcctgcactgttccatcgtaattggaggaagtcccatcctttccatggtcagattcacagaataagtaatggattctaatgtatctgtcaatgttccgtccaaatcaaaaatacaagctttatacatctttcttactccattctcttgtttcataccatttacaagtatagcataatataggatctggaaaatttcaacacaaaagaacgcccccagggaaaagttagtcgctgttccctgaaaacgttctgttggtttttctgtctgatcgtttcttttcaatccagatactggcgcatcagacgaagtgcgtttttctccaacctgctcacctgcgcctgggaaattttcacttcctttgccacctccatctgagtcttcccctcgaagaaccgaaggcggataatatatttctctcgctcatttaggtgctccatcgccgcctgcaaggacagatcctcaatccagcgctcctctttgtttttcttatcgctgatctgatccatcacatagagtgcatccccgctgtcattgtataccggttcgtttagactcaccggagcctgaatggcgtccagagcaaagacaatatcctccttggaaatgccaatttcctcggatatctcctggacagtcggctcccgaagattcttcttgacgtagttttccttggcgtagatcgccttgtacgccgtgtcccgcaacgaacggctgacccggatggaattattgtcccgcatatacctgcggatttcaccgataatcatcggcaccgcataagtagagaagcgaacatccagctctgtattaaaattgttgaccgcctttatcaggccgatacagccaatctgaaacagatcgtccggattttcgctgctccccgcaaaccgcttgattacacttaacacaagtcttaaatttcctttaatgtacttctcttttgcttcctcatcgccctccttaatccgggcgaaaagttcttccttttcttcctctttcagaagcggaagctttgaggtattcactccgcatatttccaccttgttcagtgccatcgtacatcctcctgtcacagcaaatctgcctttctaacagaaatgatgtgcataccggcacactcttatacaatgatggaaaaaataaaaaaacttttagtccttgacatgttgcacgttcggatactctgatcagtcgttccgatcccacttgtctgcaagatttaaaatctgactttccaacttagcaagatctttattagatagcccttcgtttttcattaccacgtcaagcagcctcttcgccgcggataccgcacggccaaatatctgatttgcccggattctggcaggtttttccgcagatttcttcggaatcctgagtccctcgcttaagatctcatccgtcagaagatccacggctcccccagaaaacggagcaaaagcctcatatccgagcgtctccttgatggaagccgcaaactcgtcggtcacctgatcctccccgtggacgacaaacacatgacggatcggagtctcaaaggcggacagccagtttaaaagcccgtttttgtccgcatgtccactgataccctccaaggcgcagatcctggcattaacctccacattttcaccgaagagtttcacacattccgcaccttcgatgagttttcgccccaaggtgccggccgcctggtaacccacgaacagaaccgtacactccctgcgccacagattgtgtttcagatgatggcggattcgtcccgcctcacacataccggacgccgatatgataatctttggcttctcgtcgaaattgatctgcttggactcttcacttgtagtcgtcagtttcagtcctggaaaacggagcgggttaacgcccttttgtactagttccatggcctcctcgtcaaagcaacccaacatgtttttattaaatacattggtcgcttcgattgccagcggactgtccacatacacttcaaaatccggatattccggcagcaggtttttctccttgatctcccggataaagtagagaacctcctgggtacggcccaccgcaaaggatggaacgaccacatttccaccttttgcaaacgtctcccggatcactttcgtaaagtcgcctacgtagtccggaatgccagccccatgaatccggtttccgtatgtagactcaatcactacataatccgcctccttcacggtcatcgggtccttgatgatcggttgattgatattccccacgtcaccggagaaaacaatcttcctcgtctcgccctcctccgtgatccatacctcgatacaggcagaaccaaggaggtggcccacatcgttgaagcgcacctccacaccatcgcagagagagatcttctgtccataatcacacggggcaaaaagcgctgccgcgtccactgcatcctgcattgtataaagaggttcgtaaaacggcgccccgcttcttctggccttgcggtttctccattctgcctcaaattcctggatatgcgcgctgtcacggagcatgatgccgcaaagatccgacgttgcaaaggtagatacaatctctccctggaaaccctgtttcacaaggagaggcagattgccggaatgatcgatatgggcatgcgttaacaacacatagtctatctccgaggctgataccgggatctcctgattttcatacagatccggtccctgctccattccacagtctaccaaaatgtgctttccgcatacctccaaaagatggcagcttcctgttacttcatgtgccgcaccgataaatctcaatttcataccatcgcctcttttcttttcgtatcgtatgtagatattgtatcactttttttcagataatagctatatttttattccaattttgcaatttcttttttcaacctcaccatgattttcttttccagtctggagatgtaggactgggaaattccaagtacatccgccacttccttttgcgtcatctcctcaccgtccggagttccaagaccaaaacgcatactgacgattcttcgctccctcacagaaagccttcccaccgcacggatcagcatacttttctccgcctcgctctccatatccttatagatcgtatcttcctccgtccccagaatgtccgagagcagaagttcattcccgtcccaatccacattcagcggctcgtcaatagatacctccagctttgtcttattatttctccgcagatacatcaggatctcattttcgatacaccgtgacgcataggtcgcaagcttaatattcttctctggattaaatgtattaatagctttaataagaccgatggtcccaatggaaatcagatcctccactcctacccctgtattgtcaaacttctttgcaatgtacactaccaaccttaggttatgctcaatgagctgctttctggcatgttcattatgttcgctgcaaagttgttcgattgcccttgcctcttcctccatctccagaggaggaggcaaaatatccgatccccctatataatagacttcctgcttttccggaaataaccatgtccgaaacgcaggcaggatcttttgtctgaacgcacttggcactgtaagactcataatcatgaatatcccctcctaaaaaatatccggattgacaagcatccggtaagttccatctgtcgaaatccgggtatcagaaattccaatccatacatcccggatctgctttttgctctttccccacagggtcagactttccatccgcacaagaagaatcttggcattcgtattccctacggatcgaaaaccgatctgccgctgctccttcgccttctccagaagttccaaaaccgcctctcgttccacgatgcataccggctgcccggagagcggatctttcagcctgtttccggtatcaatcagtccctgaagccggatccgttttcccgctgtttcgatctgcgcctcgcaggtatacccattctgcctatgaacctgccgaaaaaaggcccacaccgcctccaacacttcatagctgacaacagcaaaaaggaaaaaaaggctccctgtacgaatatattgtccaaaaaagctaaaaatacctccaagcaagaatcctcccccgtagagcatcagcaaagccttcacgagctcccgggcagacttcacaccaagtcctgtcataaccatagctgaattcactatcaaatgacacagaatcagacgcacgatcccgcctgtcgggattataatcacaagacaggtaagaaccgctcccattaaggcccccagaagcacccgccgcctcttaaactccatggacaacatccggcaaaccgccgcaagaagcagataatccatcataaaattgatgaggaaaaatacatcaatatagatttcatagtacatccttcacactcttttctcccgtcgctgctaaatcgattcagtatacgaacaaagagtattataagaaaaaaccacttgaaaatttgtcagaaactgacagagaaatgcgttttctttcgacatgatttgtctattccttcgtggaggtgtgttccgatgcatctggacacatctccctttttatcttaaagaaaaatggtaattttgcacagaaaaaggtatggaggcttttctgtctccatacctttcattcgtcttgtagtctgtatgatatctaaagtgccaaatatcggatctctttgtatgtccgaaccttcgattcctatttcttgaagaagtccggaatcttgatggtctgctctttcacccttcctgtccccgctgtgtaagatggtgtggaaggtgctgtaggagcatttgtctctggagctgctgtagttgttcttgtctgttgtggcatctgagtcactcttcccatatctgtcttgagtgctgtatgtgcctgtgtatcagtagcaaatacagatccggccggctttgtaactccgatcttggattttagtctggatgcagtactctctgtactgttatgtaaacctgtcgcaatgacagtcactgtggcctcgtcggacttggtctcatcgtacattgcaccaaagataatatttgcctcttctcctgcaagctcctgaacgtactctgccgcatcgcttgcgtccatcagagtgatatctccggaaatgttgataatcacgtgggacgcaccggaaatcgtcgtctcaagcagcggacttgccacagcctgttttacagcctcaagcgccttgtcgtctcctcttccatgtccgataccgatgtgagcaatgcccttgtcgatcataacggtctggatatccgcaaaatcaaggttgatcagagacggtacattgatgagatctgtaatgccctggataccctgctgaagaacttcgtccgcctttttcagagcgtccggcatcgttgttcttctgtcaacgatctcaagaagcttatcattcggaatgacaatcagtgtgtctacattttcttttaacttttcaataccagcgagggcattgttcatacgtgccctggattcaaaacggaacggctttgtaacaacgccgactgtcagggaaccctgttcttttgcgatacgtgctactactggtgtcgcacctgtacctgtaccgccgcccatgccgcatgtaacaaataccatatctgcacctttgagtgctgccgcaatctcatccgcgctctcctctgctgccttctcgccaacttccggctttgctcctgctccaagtccttttgtgagcttgtctccgatctgcatcagtgtaggagccttgcagaatgagagagcctgtttgtctgtgttgatggcgataaactctacgcctgcaatctgctcatctatcatgcggttgacagcattgttaccgcctccacctacaccaacgacgataatttttgctgctgcttctgattcatttgtcttaatttctaacaagagtgtctcctcctttgttatgctttattatttatacaccctactagtacatgtattctgccatatatactatataatatagtctttccgggcaaatttcaatagaattttttctatttttcgatttttttagtaacagttcaaccatatacaaagccgcaaaaatctaagttcaaacttgatgaaaatcataaattttttatgtactttgtatatgtggtttatctaagcgggattttcgccacaaaccccaaaagctccttcttcccgcagttcggaagcatttattccttggccgcttcacttttttcaaagcggatcgtctctgtcaactgcccgtaatgctccaagtacaatgtaccgctctggtcctccagcttttccagaatcgacggaagctgctcagccttttctttcggatctccacttccaagtttggcgcagatcttcccaaaataaagggtgatattctctccgtctgtgacaatccggtccggacttaccttgtatctggtaagaatctcctgaatctggacaatatattcaaaaatagaggaatcctccaccggaagtttctctccctgctccacctttgagacgtccagtccttcaaccaggctcacaccatcccttggagcgtccgtaatgccaagtaccgtcccctcattgtcaaaataaatatagctctcttggttctgtacatatccggcaggggatttttccttgacgactacacggatcgtccacggattgaccatgtggaacttcatactctgaacagtcgccggctccgggaaatccccaaactttgtactaagtagcaggacaagagaattgccatcccctccctgctcacggatatactgtctgatctcaccctccgtgagaaaatcagacccctccacccgaatttctctgagctgaaataagaggagaaacaaaatgatggcagcaagaaccgccgccccgcttcccagtcttttgatgatctgcctgcgcctggtacgttttaattcttttctcttctcatccctttgcacgacctgttcattcatcgatgtgcctcctgtatgttccatcattaacgtttctattttaccaactggccacgctgaatacaagccccatttccacaagaagaaagacaaccgacgtccctccatagctgataaaggggagcgtgataccagtattcggaatcgtattggtcacgaccgcgatatttaagattacctgtatcatcatgtgcgccatggctcctgccgcaatcagcgcgccgaacaaatccgacgcatgggaggcaatcacgaaaaaacgccagatcaaaaggaaaaacaacaaaatcacaaggatagcccccacaagtccgagctcctcacagatgatggaaaaaatcatgtcgttttgtgcctccggcacgaagccgagcttctggatactactgccaagccctttcccgaacaggccgccggagccaatggcaaagagtccctggagcgtctggtaccctttctcatatttctccggattctgccagatggcgatacgctccaaacggtaactctccagtccaagaaagatagccatgaatccaatccctgtcaccgccatccatatgaactgggcatatttcggactagcggtaaagatcaggatcacggcaatgccaagaataatcaccgccgtgcttaagttgctggcccccacaagtcctacaacaggaagggcaaacagcatgatcctgaataatgtggtaagctttccgatttttttgacgttttttgtcaccagccatgcgagaaatacaatcaacgcaactttcacgtattctgacggttgaaaagaaaatggccccaaagacagccatcttttggagccattatattcatcgccgaacaacatgacggcaatgcaaagtacaattgccatcagataccccggcaccgccagcttttcccagatatgataatcggttctggcgaccgcatacatcccggccaatccaagggatgtagcgaagatctgttttttcaaatagtaaaaaggatctccgaactttatctgtccattataggaactggtactgtaaaggattatcagtcctattatcacaagtaaaaaaacaatcaccagaagcaccttatccgtccctctggattccggtttttccgcctgcttcaatctatccctctccttacagcgattttaccaagtctttaaacttctctccccgttcttcgtagcttcggaacatatcccagcttgcacacgccggcgaaagcaatacagcatcccccgctttggcttcttctttcgcacaccgcactgcatcctccaaactatccgcaaaggcgtagtcggtaaatccatatttctccgcagtcattgcaattttctccttcgtctccccgagcaggatgagtttctttacttttccctgaaagctttcgatccattcattgtattcagactgcttatcatagccccctccgatcagaatggttggacgattcattgcggtaataccacggattgctgcgtccggattcgtccccttcgaatcgttatagtatgccactccatctttttccatcacgaattcgatcctgtgttccactcctgaaaacccctttatgactttccggattgtctccatcggtacgccatagagcgctgctatcgccaccgccgccatcacattttcataattatgggtaccaagcagcatgagctcctccacacggcaaaccggaaccacttcctgattccggtagataatctccccgtcttttaagtaaatccccaccggaagttcccttttactactaaaataaaatggtgtcgcttctgtctcttccccgaacacccggagcacgtcatcttcataattcagcacacagtagtcatccttcgtctggtttcttgtaatggcctctttggcgctgatatagttctccatggtgtggtgtctgttcagatgatccggcgtaatatttaagatcgcgctgatcttcggtgcaaacccatgaatcgtctccagctggaaactgctgatctccgcaacagttacactttgctctgtcatcttcatagcctccatggtgtacggattaccgatgtttccaactacaaacacctcactttgatgagccttcataatctcaccaagaagtgtcgtggtggtcgtctttccattcgtccccgtaatagccagtacatctcccctgccatagtgatatgcaagctcaatttctccccagatcgggatcccgtccgccttcatcttctccacaaccggaagatccactggaacacctggacttaaaaccgcaagaccgattttttccatctgatcctccggaaacggtccgaatattatttccgccttactgtcttttggcagacgcctccggatttcttccggatcgagcttttcatttccatcatataagatcgtatcaacgccctcgtgctccagaagcatcaccgcaccaatcccactctttccagagccgaacacgagtacctttttcccgttttttaacattactcttccgtcctttcttcttatagtgccaacagcgcaatcagacacagaatcgccgtgataatggaaaagactgccacgatcctcgtctcagaccatccacagagctcaaaatgatgatgaatcggagccatcttaaagatccgttttccacctgtcttcttaaaataagtaacctgaatcatcaccgacgccacctctatcagataaatcattccgacaatgatgatgaaaatgggcatctgaagcatatatgccgtggacgccacgaatcctccaagagccagagatccggtgtctcccataaacacactggccggatagacattaaacagaaggaatcccataagcgcacctaccaccgcacaggtgaccggctcaatcccactctttgttcctactgccaccaccgtaaagaatgtagcaacaagcacggtcacactggaggcaagcccatcgagtccatctgtaaaattgacgccgttgaccgtaccgatcactgctataaataacagcggaatggcaagccatcctatattccagtatcttccaccagaaaatggaatcagaagggtcaacggtgtatgagtaacatggatcagataataggcaaataccgcagttatcacaatctgaagggcgaacttctgctttggaaagagtccgtccgagcgcttcatcacaaccttgagataatcatccagaaatccgatcagtccaaacccaagcgttacgaacaagatcggaataatcttcggataatcctttacataaaagagggaggtaactacaatagaagccagaatcatcacgcctcccatggtcggcgtccccgccttctgtagatgagactccaccccctccacacgttctgtctgtttcattttcattttccgtaacatcggaatcacaatcggccccataatcacactcagtacaaatgagatcagaaccggtactacgaatgtaaaatccatatctgcacctcttcatcctttggtttctaaacaggcctatatgcctgcgtaccattataacgtatttgtaccatcaatgcaagtcgaccgccatggctcgctctttctttctgccgcaggctgctcttcttttctgtcacggtcactcttccttttcagactttgcgttctcttgtttttcgatgccaaggtacggcagtacgtcatcaaaaatctcccgcacaaccggggctgcgatcgttccgccataatagattcccttagggtcatagataacacacattcccagaatctgcggattttcggccggagcaaagccaataaaggaagaaatatatttgttggcgcttcttggcagagtctgggacgtggccgtctttcctccgatactgtatccctcgatataggcgtttttcccggatccgactgaaaccacgctctccaggattttccgcatcgtctctgacgttttctcagatatgacccttctgccctgtttatccgaaaatgtcttaagcgtcttcccgctctcactgtccagcacttctaccccaaaatgaggcgttaccctctttcctccattgatcaaggaactgactgtggcggccatctgtaccggcgtcacctggaacgactgaccgaatgtcatggtagcaagctctacctccccgatatcttccagccggtgcatgatagtagaagcctcccccggaagatccaccccggtcttttccatcagcccgaactgttcgaaatagtcacagaaccgttccgctccaaggcgtagtccaatttccatgaaaaccgggttacaggaattctggacgccctccacaaacgtctcggcaccgtgcccgcctaccttgtggcaccggatcctccgatcctccacgatcttgtatcccggacagacaaacgtatcatccagatcaacgaccccctcctccagacaggcgctggaggtgatgattttaaaggtagaacccggctcataggtgtcgttgatacacccgtttctccacatctggtttaaaagttcctgcttttcatcctccgaatcatatgtcgttccctccggaagttcaaatggttcgttcagattaaactccggccagttcaccatagcatagatctctccgttctgcggattcatcaggatgatcgccaccttctccgcctgcttttcctccattaccttctgcgccatctgctgggcgtacttctgaatgttataatcgatgctgatccgcaaggtattgccggcagtcggctctgcccggtcctctgcgatcccctccagctccacgcctcttgcgtccgtagtggagagaatcattccattttctcctttcagataatcttcgtacttgacctccaggccgataatcccctgattatcaccccctgtgaagccaagcaccttgctggcaagctcttcgtacggataataccgtttgaaatcctcatccaccttgacgcctgccagattcatctcccggatccggtctccaacttctttttccacgttggttttgattcgttccatagaggaaactttctccacctttttccgtacggtttcttcctccatctccagtgtcccggcaagagctttcgtcactgcgtccgcatcctcgatctgactgtgaatcaccgaaacggtacagaccgtcttattggtagcaagtactttaccgttccggtcgataatctctcctcttgccgccttgatctcccgctcccgctcgtggagagcctcggccttcttctgataatattccgcgtcaaaaatcatcagataacaaagtcttgcaatcagccccagtatcattagcgacgccccgataaacacaatgagaatcttccttttattataggttttattcttcataaaaaacctcacagaagtgattgatatagcttattaatccttctgtgaggttattctatttattccgattttgtaatattcaaatatggaaatgcttctttcataatgtccgcagaaagtcttgtcgccagataacttgccgcctgctgtgccagattcggctcgtccacaacaacgtatatcataacttccggattttcctgcggggcatatccaatgaaagagtttaagttctttccttggcttcgaggcagtttctccgcagtaccggtctttccgccaatagcatacccctctacctgggctgattttccacttccctcttctacgactccaagcatatagtctttcagaatctcgcacgtttcctgggatacggtttttcttgccagcaccggagtcttcgtctccacaacgtccccctgagcattgcggatctctttcaccagatacggttcatagtaatttcccccattgatcagggagcaaaaacccgccgcaagctgtgtcatcgacacattaaaattctgtccaaaagcgttggttcccagatcgatgggctgcatgttatcagccgtgtacagaagattggatgtatccccctctccaggcagatcaatgcctgtgtactctccaaaaccaaagatatgctgataccggcagaagtcctccgcgccgagtgtatctgcaatatgcatcattccgacgttgcaggaattttccagcacttgttttaatgtttctgtcccatgtccgtctgtggcgatacaggaaaccggcttggcaactccttcataggaataggaaccgccgcatacatatgtctcatctccagtcagtttgccggtctcaaatccggccgccatcgtaaacggcttcatcgtggatcccggttcaaacgtatcgctgacgcagaagtttctccacagcgcattaagtgtctccagacgctcctcctcagtcatggcctcctgctcctctgtcgtataatatttcgacagatcccttggctgattcagatcaaaattcgggtaacttgcctcagccagaatagctccagtgtttggatccatcatgatcacggctgtgtttttcgtaccctcgccctcacggtagttatcccgcagcctttcattcaattccagaatatgcttctccacgatcgcctgcagattcgcgtcaatcgttgtgacaatggaattgccgtccgtcgggcttttcactacgttctctgagctggatccagacgagagataccctgtttttttcccatctgttccgttcagttcgttattataatatgcctccagaccgatcgttccgctgtttcctgaggaagtaaatccgatcacatcacttgccatggttccgtaagggtaggttctcgtataggaatcttccagtgtcacactgacaatatttttgctcttatccatcttcgtctgaaaatcttttccggtctcataatccacatcttttttcaagatcacatagcgactgtccgactcgtcctgcaaaatctccctgagatctgactcatccaggtcaaaccctttgacaagcgcttccactgtggcattgatcttcttattctgataggacgtcttcgtctccaggagtcccgccacatcgaggatcacgttgtaggaacgctcgcttgtagccagaactgtatcatttgtatccagaatatcgccacgtttaaagtggatgatctgactcccgcttcgcatctggctcataacctgcttctggtactcctcccctttgacaagatttaaggcaactgcctttcctgccaaaaaaacaaaagccagtacgattgccgtaaacactcctaccagctttattttcattcttttcggaaattttttatgaaaattctgggattctttttgagttctctttctttccatggaattccccttttcactatgctgttatttatccgtcgcttctccatcttccggaatgctttcgtactgtctgattttatgatctcctgcgctttggtatttcacaatctgggaatcctccgcatataccataccaagctccgctgccctttgctgaacctcgtccagattgacggaatttgcgatatgattgtattctgatgtatttttctctttcaggctggtgatctctgtccgcagactttcaatttttcttgtcttctgttccaaatccgcctgggctccaagataatgaaagcagacaaatagtgcgaccgccaccgccccggcaaaaaatgtcacataaccaaagccgagcttcattgccctgcgctggttctttttcgtctgcggactcacagtcctggcctcctcttcgtagtatcctgcctcctgatgtatctgcggtcgtctgacccggacaagattatcgtacatatatgcttcgttatgtgttcttcgtttctttcctgatgccatacacgttccctcttttctgtgtctgatacttcacacgatgtttcgtatcagatatgctcgaaaatacgaagcttcgcgctctttgatctgctgttttccactgtctctgtttcccccggaagaattggctttctcgtgatcacctttccttttgacttcttcccacatacacacactggaaaatggctcggacaggtgcacggattctcgtttctgcgaaacgcttcctttacaatccgatcttccagtgaatggaatgtaataatgcagatccttccacctttattaagtaagtcaatcatctcatccaaagattcccttaaaactgtcagttcctgattcagctcaatccggatcgcctgaaacgtcctcttggccggatgacccgacattttctgaaatttcattgggatcgatgcttttataatctctgtaagttctaaagtggttgtaataggacctttttcccgttccattacaatgtgctttgcgatgttcttcgcaaatctatcttctccgtaatcacgaatgatgcgaaaaaggtccatctcactgtatccattgacaatatcagcggctgtctttgcctgccgggtgtccatccgcatatcaagcggcgcatcctttgtgtatgagaatccacgctctgccgtatccaactgataagacgatacgcccagatcgaggacaatcccatccactttgtcaatgcctaattcttttagccgcagcttcatatcacaatagttgctccttacgattgtgactttctccccgaaactgcgaagccggattcctgccgcttcaatcgcggcggcgtcctggtctattccgataaaactccccttgtcacttaactgcttacatacttcaaaagcatgtccgcctccaccaagcgttccatctacgtaaatgccgtctggcttgatgttcagaccatttacgacctcttctaataatactgatttgtgttcaaatgccatggtttcctccttcacctgctacacctaaatgcgaaggcccagatcttccatgtcgccggcgatatcatcgatatccgcctccacttcctcattgtgtgcatcccaggctttcttgtcccagatttcaatcttatcaaggacacctgccagtaccacttccttttccagtccggcataagctctcagggcagaagagataagtactcgaccttgcttgtcaagttcgccatcgacagcgcttccaagaaagaaccgtttgaagtctctggcttttttgttggtaagtggtaattcccggagcttatcttcaaaggcgctccattcattgtccggatacacaaataaacagccgtccattccctttgttatcacgaaatgttctcccagactttcgcggaacttagaagggatgatgaggcggccttttgtgtcaatgctatgattgaattctccgttcaacatgcaactcaccttcttccaaaacgggaatgtcttccccattttgtaccactactctccactttctaccacttgaaaccattgtaaaccacacaactacctttttcaagtactttttccaaaatgattcttaataatttcttacctcctttgacccttttcgacactcatttcacacaattaccggaagctctgaaagccataccctgggatgatacacagtttcctatacaaaaaaacagtatggccgaaaccatactgtcttctttcttcatcctattctattctactgcctctgcattactaagtcctgaaagataatcatcgaaagcggtgtaatctgctgtcacgctcgctctcggtttattctcctcaattttctgatatccggaatatccgatccaaacacagatcaacacaacaatgactgctgctagtgctgtctttagacggaagagcagcttctttttctttgcttctttttttctcttttccctgttatttttataagaatctgcatttgtcaggctcataactgttactccttttgcactcaactagtatatatgatatcacattcaccggacaaatacaagtttggaatccggatttcacatttcccacacaaaacggcattatcttataccgcaatgataatccctccgtcatttgcatacatgctgctgacccctcttgtatcaagaacaatgatatctccaagcggcagcttctttaaaagcatctctctgaccatctctgcccgcgccggacagttgcagtgagcgataccaagtgtcttcttctccggggaaacaatctcctccgacacacgatccaccatcttcgccagagccttgttgattccccttgcctgcccgtgctggatgatgacgccctgctttgtggctcccatcaccggcttaatattcaaaacagacgccgccaaggctttcagtccggtgagtcttccgttcttacgcaaggtctccagtgattccagaacaaaatacgtattttgtccgtcgatatatgtctccaccgcattgaccacttcctgaaagccgagcccccgctcttcacactccatgatcttcttcgtgatcagcgtctcacccacagaagcggaccgggaattgaaaatgtagatatctttctgtccgtgctcctcaaggaacagatttttcccaaggacggcgctgttgtacgaaccgctcagctctgctgaaagcgtcaccacatagactctctcttcctcgccctcaaatgctttcatataagcctccggagacggacaggatgacttaggacattcactgcatcttgccacacggaccaaaaagtccgcctggtcaaatgtctcgtcatcaacaaccagatgtccgcctacattcaatgtgagagaagccgtaaaaatattcccggcttttttcatatcaggcgtaagttctccgcagctatctacaatgactttataactcatctctattcctcctacataccattgtatgatttttacatctataatatgtagttttcaatactacttccttatcataacacaaaccaggaggaaagaaaaggaattttatctgcggattttgatttttcctgagacgttcaacacaatccccatctcaatcatcagaaagaccgctgaagtacctccgtaactgataaacggcagtgtaattcctgtcgtcggaatcacattcagcacaaccgctacgttcaaaagaacctggatggcgatgtgggcgaagactccggtcacgatcagcgatccatagagatccggcgcattctgtgcgataaacatcagacggtaaagcaacattccaaacagtaccaggacaacgatcagtccgaagacccccagctcctcacaaatgatagaaagaatcatatcattctgcggctccgggatcaccatcttctgagcgctgccccccagtccctttccgaaaaatccgccgcttccgattgccagaagtccctgcattgtctggaaagctccgcttttggcgtatttttccgggtccacccaggagaggattctctgtaaacggaagttcccgctggactccaaaagccttcccagaatctgtcccgcaatcagtccgccaaccacaaggcagacaaaaacaattccgatctttcttgtccgtggataagccacaaaaaaaataacagccgaaattccaaatacaatgatcgctgtacttaagttttccgtcagcacgaatacacctgccgccgcaagtattccaaacaggagaatctgaagcgcccccttttttgtatacgcttttttcccaaacttacaaatcaagtaaggaataaaaagtatcattgcaatctttgtgatttcggacggctgaaatcgctgaataacaggaaatcgaagccatctcctcgccccattgacctcaacccccaacggcgtctgcaccagagccatcaggatgaaggaaacgacataaaggatcgttgcataccgtgtgtaacgatgataatctaccttcgtcactacatacatgaccaaaaggctccccccactaaacagaagctgtcgtctgaaataaaaggcaccgtcccccttatagtcaatctgagcagaataatagctcgtgctgtaaagcatgatcagtccaaaacagatcagaaaaatcaacacagctacaagtccgtaatcaaaataagcgtactcggcgtttcccgccattttcttctgacgtatcattctttttcgtttcagtctttgccgttgatccatatcaaaatcactccatatttttctttatacttccccgatgattccttattatatccgcaacagaaaggaaaaacaaccttcttgccaaaatgaattgtaactttcgctttctttttccatatgataatcttagaaaaaagattgaaaggagtttcggtatgcagaattattatcagcgtcccgcgtttcgccagccttatcaaaaccgcgagaacagccgtgaagctactcgcgaaatcaaccggcagaaaccttgcgacgtgaaagacaaactgagaaaagaattccctgtcgccatggcctacgttccttggcagcgctatctggaaccttatccggtctgcaaaggttttatcagaggaaccatttttgaagaacttgacaaaccatttcttggcaaagggggatgccgcttatgaaaaacttcccttccagaaaagagcttttaaatcatattaataccgtcagctttgcggtagatgacattcagctctatcttgatacccacccggacgatgaagaggcgcttgcttattttcacaaatataaagaacagcgtgttaaagcactcaaggagtatgccgcatgttatggtccactgacaatcgacacggtggacgaatcctgcggcgacagatggacctggatcaatgaaccgtggccatggcaggaaggagggtgctgatttatgtggaattatgaaaaaagacttcagtttccggtaaaaatttccaaaccggatccaaaggctgcccagattatcattacacagttcggcggaccggacggtgaacttgcggcgtctatgcgttatctgtcccaacggtacaccatgccttacaaggaagtcaccggaattctgaccgatatcgggaccgaagaatccgtaccgaatccctccttcctctttttgtctttctttgtctatttccgtctaaatatgtcgcttttctgattttctatttttctatattataatatggcattgtgggtttttctcagatgtaagagaaaggagaagcatggaaaacctgtcacagctgattcacaggctcggaatcaacgcgacataccggggatatcattatctttacagagcagtccttctggccctctccgacgaagactatctgctttccatcacaaagaagatgtatctggatatcgcagcctactatggcatcccggtcagtaatgtagaacggaatctgcggactgtcatcaccatctgctgggagcggggaaaccgggaatttctgactgaaatcgcatcctatcccctgactttcaggccatccgccggggaattcatcgatattctcgttgcatattgccgggagcatcaaatcagcgaatgatctggttacatattgttcatgcttttttcaaatcagaaacatagttttttcatattcttcctgtatagtaaaaaccatagaaagcaaatacctttctaagcaaacaattttctttttcataattctgccggtacagtatctgtaccggcactcctcattttgggagcttttcatattctcctgtatttttacatagattgctacaaaaccgacaaagagggttttgtttttgtcctattgtatgtatcttagaaaatccagaaaagatctggaactggagcgtctccagcctggaagtaccttagcacgccatgaatccatcctctgttctttggccaaatccttgacaatttctgttcagtctatctaccgtgaagtagggtccggcgacacgattcaggaccgcccggtgatgcagcagcttcttacggaagtggaaaagggcctctgggagggcgttctcgtgatggaaatagaacggctggcacggggcgattccatcgaccagggaattgtcacccgaacgttccagtacagtcgcacacggatcatcacaccctataaaatctatgaacccggaaatgactttgacctggaatactttgaatttagtctcttcatgtcccgccgggaatacaaaaccatcaaccgcagaatgcagtctggccgccttgccagtgtccgtgaggggaaatacgtcggcaacatcgccccatttggctatgaccgtgtccggctcccggaccaaaaaggctttaccctggaaccaaacaaagaagcgaatgccgtccgcctgattttttctctgttctgtcagcgtggatgtacgatcagggagattgtctccctgataaacgatcagaaagagtatcgcccacgtaaagccgcttccttcacctattcttccattcacgacattcttgaaaatccggtctatatcggaaagcttcgctggaattaccgcaagacaactccacaactaaaagacggcgtcctcacccggcaccgtccccgtcaaagtgagtaccttctcgtccagggactccaccccgccctgatctctgaggaatgtttctttctggcacagcgcctccttcatccggattcggggcagaagaactcgcccatatggaaatgatctgtgcgattgtccatcaactgacgagaaatctgacaccagaggaaattgagcgctcaggatttggcacctactatgtggatcacacactggcgctctggcctcaagccgcaagtggtatgccgtggaccgctacggtcttccagtctaagggagatcccatcacagatctccatgaggatctcgccgcagaacaaaaagcgcgcacaacatacgacaacatcctccggcttatcagcgacccggatatcattgctccaatccgtttcctcagagaacgtgaaattgttcattaccaaagattcggagaatctttaagaatcgtgaccgaccggctcgacagcaaaaacttctatgctttcaacccggaattcgacaatccggcctgccgttcttaaagaaaagacgggactgcttcggtctgagaaggcacagacagttaaaacaaacgggggtgttcttcgcacacccccgtctctataactgatggtatctcgttatttcatcagttttttaatcgtctcacacaattcatccacacattcaacatttccttcctggatatcctttaccacgcaggaatgaatatgctcggaaagcagtgtcttattaaacccgttcaaagccgcctgaatcgcctgtacctgaacaaggatatcgatacagtagcgatcctcttccaccatcttcttcacaccgcgaacctgaccttcgatgcggctcagccgattaaccagatcccggtattccttaccttccctgtgctttgtcttttcttcttgcatcctctttcccttgctttctactcatcgtcatcccgttactgccgaagttagagtatccataccctgtcccggtatatattcatactacaatgacaacaagtgtttgtcaagtggctttcccgattttcccaaaaggccttaacttaattgctttgtcagggtaacttccacgtctttctccttgtactctccctgtccctgtgggaactgtacggtcagggtcactttctcaccgatccggtagtaactgagctgctcctgtaagctttccatattattcactccggatccttcgattccggtaatgacacatccctttgtgatacccgcctcagccgcgccgccgcctttcatcactctggaaacatagacgccttccggcatcccgaattgctctgagctctgagaatctacattcgttccttcaataccgatatatcctctccgtgtttccggcacctgtgtcctcgtctctttattcatcaggttagtaatgatatcagtcacatcagaaatcgggatcgcatatcccattccctccactgcagaatcgtttacttttactgtattgattccaatgacctccccccggctgtttaaaagcgctccgccgctgtttcccggattgatggctgcattcgtctgaatcagcttgctgtcaaatccttccatttcaatctcccggtctttggcactgacaatcccgtttgtcacagactgcccatagccaagcgcattgccgatcgcaatcacctcttctccaacgagaagattctccgaatcaccaagtaccgcaactttgatgctgtcctttgtatcgctgctgatctgtttcagcggaacagcaaccaccgccagatccttggtggcatcggtccccttaaccaccgcttccacactcgtttcatcatggaacgtgaccgtcaatgtctgactcttctcgatcacatgattgtttgtcacgatcatcagctctgaatcattctgtcctacaatgattccggatcctgcactcgtctgctcctgctcccggatcccgccgaagaaatcctgtacctgcttgacactcatattctggatagagacaacaaacggcatggaattagccgcaatctgcgtgatatcagatcctttcatctccccatcggcagaatctgtcgtctgcaccggctgtacctgggaagaattctgggaactatttcctgtccccaggacttttccggatatataatttaccccctgaaaactcagccctccgactacaccgaataatacagcaagtcccgcgacctttgccgccatggatcctttgccccttttcttcggcggcttcggatgtctgtattctggagatccgtattcggattcattcccggtttgctcttctcccggacgataatattcgtattcttgattcataacatttatcccctttctgacagttatcccttttctactcgatacacagtctatcgaataaatgtgtatattttgtgatgaaatcataaacaaaagctgaattcccttctcggaaatccagctcttttctctattctacagtcacagatttggcaagatttctcggcttatccacatcgcagccacgtcctactgccacataatatccaaataactgaagcggtacaatggcaagagaattcgtgaaaaaccgatttgtctccggaatatagactacataatccgccgccttctccacatccagatttccctcattggtgactgccatgacaaaggcacctcgcgtcttgacctcttccatgttgctgagcatttttttatagagatcctcctgggtcagtaccgctgtaacaagcgttccctcctcaatcaaagaaatcgttccgtgctttaactccccggcagcgtaggcctctgagtgaatataagagacttctttcagcttcagggaaccttccaaagaaatcgcatagtcaattccccgtccgataaaaaaaatgcttctggctgccagataccggttggcaaacttctggatccgatccttatggctgagcaacatctccacctgtgcgggaagctttttcagatcttcgatcatctccgctaattcactctcgctgatcgctcctcttgcgtatgcaaagcgcatagccagaagatataatgcagtcaactgacaggagtaagccttcgtagtcgctaccgcaatctctggccccgcccaggtgtatagtacattgtccgcttctctggcaatagagcttcctacaacattgacgattccaagcaccttgcatcctttctttttggcttctcttaaagccgccagagaatccgccgtctcaccggactggctgacgacaattacaagggtcccttctgccagaatcggatcccggtatcggaattcggacgctagatccacctctaccgggattctcgccatgccttccaacacatattttcctgtcataccggcgtggtaggcagaaccgcaggctacaatcacgatcttactgaccgcccggatctcctcatcattcatgcccagttcctcgattacgatctgtccgtctttgatccgaggtgaaaatgtatccgcaatcgccttcggctgttcgtacatctcctttaacatgaagtgctcgtatccacccttctccgcagcatcggcatcccagtcaatatgaaccggctttttctgaagaggctcctcatccactgtgaaaaactccatatcttgttcagtgagccttacaatctcttcattctctataaagtagacatctcttgtatatttcagcactgctggtacatctgaggcgataatactgcccccatccgtatgtcctacgatcagcgggctgtccttccggacagcgtagagctcattgggatgatccttaaaaatgataccgagagcataagatccttccatccggtgcatgatcttcgtcactgcttccagtggatttcccttgtaataataatccagaaggtgtgcgatcacctccgtatctgtctcagatacaaactggtatcctctgccctccaacttctttttcagcttgatgtagttctcgataattccattgtggacgactacaatcgtctcttcggtgttcagatgaggatgggcgttcgtatcagatggggaaccatgtgtcgcccaccgggtatgcccgattccaagtgtacccggcaacaggatgccatcgtgtgtgagctcgctaagtgccttcagacgccctttcgtctttgccacattgatcttctctccgtcaaaaaccgcaatcccggcagaatcatagcccctgtactccagctttgacagaccatccagcaaaatcggtgctgcttcttcttttccaatgtatccaactattccgcacatatttctcctccattttgtacaatcagccgttttttttatacttttagcatcacggccattattttagcaccttccctgccggttgtaaagtattattttctgaaagacaagattgcaaaacttgtccgaaatatccgtaaagtgcaaaacagcagggcatgtaccctgctgtttcttatcgtttcctttctacagatcaatgaaatcgatagaaaagtcgtcatcatcatctttttgcgtctttttctttttaccacgcccgaacttcttggacggtctggattcctcataattctcttcaaagtcgtcgtaatcgtcatcatagtcatcgtcatagtcggaatcaaaatcgctgtcatcgtcggaggattcttctgtgtagtcatcctcataatcatcctcaaagtcctcgtagtcatcttcataatcttcaaactcgtcgtctgcggaggaatcgtagtccccatagtcatcgctgtcaaactgctcgaactcatcaaatccttcttccggcatctggatctttggcagatcatcagactccttcttcatcgaagacttcgtctccggcccctgtgtacctgatgaagagcgcttttgggtgaggtcatccagctcatcgtacacatcgtccaactccagatttctgcggtgcagcttcactgcaaggatcagaatgagaagaagaagaacgaggaacacaaatcctgctccaatcagtacgacttccacatgatcctgtacaaaagtggtcaccttcccaaagacgccgctgtcagaatcctttccggatgtcgttgccgtcacatcatctccataatactggtatgtctgatccttagaatcatagcggtaaatcgcctgatctccatcagcattcaaaccattcataagataatatctgctgttcttgctgtcctgccatgcaggaagagtctgagtatcggaaagctccagctctacttcctggtatcttgcaggaagcgtcacatcccctctgtcgcccagaagaatcaaagaaccgccagaggcaagattcacaatctgaatcggggaaacgcttccatcctctgcatgataaaggaaaaacgcgcctacattgccggaatccaacaggtataaaagctgtacattaccattctcttttaccgctccctttaccgtctcgccatttaccgtaatatctgccgcggaaaatcccgcaggaagctcattacttgggaaactgcttgctaccgtgtattcggtatcatttacattcagtgtgactttgctgcctgttgccgtgccagaagatgactgcgtcccgtctcctgcctcaatctttacatcggagtatcccggaggatccaaaagatttagtgtctcgccattggcatccgttacttccgcgcctttctgctcaagcctcgtttctccctggacgagcgcctcaaactccatattgaaatccagacgctcctgaccatttacagtcccggaataaactaaagttccatctccctgatctgtgacgtttgcatcaccgtcaacatatctcatggccgtcgtatcgtaattcatcgtcagctcaacctggccaaggtttccgtcacgattcactacgcttccctgtatggtgaacgtctctccgacctgaatcccgtcaaggtctgtaaagaaaatcactccatctgccgcattgacatacagccgggtaaacggtactaccagacacactgcaagcagtatgcctgccaatcgtttcatcaatttcatatttgtacctcttctttcgtctcagattttgtttacatacataagaatatgatacacggtttacgacgaaatgtccagaaggtatcttgtgaaatccagatacttttccttatatttttcttaaacagattttgaagatcggttatggctccagtctgtgcatgtctctcgggaacagagatgctcttctgacattgctgtatcctaagagctggcttgtaaggcgttccagaccgatccccatacctccgtgaggcggcagccctgcccggtgtgccatgagatagcttgcaaatgattccgggcgcatccccctgcgttgtaactttgccacctgctcttcgtagttatgaattctgaggcctccggtagtaatttccaaaccttgatagagaaggtcaaagcttcttgtcagttccggatgttctttactttccatggtgtagaacggccgctttttctccgggtattccgtcacaaacacaaactcgctgccggtcttttctttgacccattggcagatccttttttcttcctccggctccagatcttcagggtctgtcacctcactgtggcgaatccgcgccacaatctccttgactttcgcaaaaggaatgaccggaatctcctgtaaatccggcagactgaccttgagaagcgcaagttcctcttcatattcctccttcagataagaaaacatcgatttcagcatgtaagtctccgtctccatcagtgtttccacactcgttacatagcccatctccacgtctacactggtgtattcgttgagatgccgggaggtatcgtgtttctccgcccggaacaccggggcaatttcaaagaccctttcatgaactccgaccatcatctgcttataaaactgcggactctgggcaagataggcttcttttccaaagtagtccatacgaaagatatttgctccgccctccgctccggcggaaccgatcttcggagtatggatttccgtaaatccgtactttcggaaaaagatgcgaaatccatccgtaattccgttctggatgcggaaaacagcccgttccttttcattccgcagtgtcaccggacggtagtccaaaagtgtcgcgagagaagtgtccacctctttttgattgatcacaacctggcttatttcataaggttttgagaggatttccacatcaatgagatgaagttctgcccccatacgggaccgctcttccccgacgacttctgcctggaagatcacacagctttcctcaacaagcacttccagtggaaatttcgccttttcttctgaataaacacactggtaaatgtgcttggcgcaacggagcagcacaaacgcaaatcctctcatctttctgattttatagacacttccgtggattcggatcacttctcctatatgctccaaaagattcgtttctgtcaccggtacggagcttcctgtgattctatacatttcattcattcctgattttccttctttctcgtttttgatttctgtttttctctttcccactttttgaacctttcttcgatccgcctgccatccatgtgggcatcgtctttatgtcccatttgatcacaacctttctctatctgtcaggaactcttttgtttccgggaaacaaaaaaacagaaccacacaagactctctccacatcctgtgtgattctgctcttcttttttccacacaggtacaacacaagaagcgcttgtacctgtgaatcgttcacaatacaagcgctacctatcgtcgtccctgtacatacttacaaaattactcactggggtcatacaaaagcagctcctttcgatttcccccattctacaccagagcatttcatattgtcaagcagagaaattattttttttgtatttttcataccgtatttccgaaaactttcttctggaaaaaaatactgcaagccagactcctaaaaatacaattaccagaaacggtgtcacaaaaaagcatacgatcgctccggccacaaaccacaaagcccacaaaaagagttggtttctcgccccggtcaccaccagagccgcatcgtagcactttcgtttttccttgggaagctccctgtagcttttgatgagccacacacatttttctcccagaatggtgaacacaactgcgtgtgccacatgcagagccgccatcatcatacagagaaatacagaaattacaattacccgttccatgttccttctcctttgcatcggtcttctattatcttactccgaattttggaaaaggcaagcgttttctcagccaaattatcgttttattgtattagccaacattcgcctgaaacttctgtcttctacctggtcttttgcacacggataacgattgcggccgcaagaagcgcaactccggtaacagcaagatatactttctctttgtagcttccagaaacaagggagaacagataccagttccccagatattttgcccctgccccaaaagagaaaagataatatccaagtgatgccatgtatccgatcaccggattgtcactcagtgcaaaggccgccgcaccgaatcctcctaagaataccatccccgcaagggacgccataaaatagtttccaaacgggaagtcgcatcctcctctttcaagtcccaggagaaacactcctgtcagagcagccatgacagccacattcaaaaagattcttaccaggtagatacttcccatggacgtatatctggcacggatcagatcccggatggctttatcctgttccggcaaaaagaccgggatcaaaaggagcatccccggaagaaccacataaaaatccaaaagccttgcagtctctccaacgcttaaattgcggactcccgcaaggagaggcgcagccgcaaaaagcatgatactaacgagcgcctgctgtggcagatgatgccggacgtactcttttccggatgcgagatatcttcccatttccccatttcccctttcttcttgcttcaaagatcatagctgctccggtcacaagagcaagcgccagtacaacataaaagatacggtttagcaaaagctgcgaaaactgatcatggaatcctgcataattcatctccgtattatgtcttggaatcagattcatcccatactggcccccgtgcatcgtctcctctccggagaagagagaaagaaaccaccatgccgcctgaacaagaactccggctgccgttccggtcagctccgtaaagaacatgccaagggctgtcactacaaggatggtcggcaaaagccatcccaggctgtagacgacaaacgcactcatatgaagatccacatcgatgccttttccaaagcttacgcactccatgagcggatggcaggtaaggagcagtaccggcacaaacatggagaaacaaagcgctgcatatctgctgaagagaattgtaaaagacgaagctttccgcgtgtagatcagctctttcatctgtgctctcttatcccggatctcccttgtcactgctacaaaaaccgggagaatcgccaggatgattcccatatagtcgcagaacaatcttgcatatcctccggtcagtccgtctttttccagaagattatgatactcttccagtgcgtcctcataggtcatctccaccactgcgctgttcttaattgcctctgccgtaaaatcggatcctggtccgagaatcttgcagacttccttcatctcctttaagaatgtttcataagtcaacccgccttttggtttcagagtgtaatttcctgccttgataacactactgccgtccggcatttccactttctgctcttcttcccaggcatcgaagtctttctggagatcttctatcggaagcccggtcatctcttccaggattgtctccactttctgcttctcagaatcattaagattcacatgcttgttaaaaccgatcggtgctgtcgtaaagctgttatgaaaataggattccgcgagattaccaagcgctccttgtatctggtcttccggtttgtcggaaagcttcatgccatagcttccttcctgctctggctgaggctttggttcaaaggtgatcgttcccatctggctgaaaaaaaacagtgccactgccagaatgtagagccagaaaatcaggctcttccacagcatacgacattcctttttaaacaacgtccagatcatgtgaaaatccctccttttcctgcatcagatacagataggcgtcctccacttgtggctcgcaggccgtagcccggatcttcggaggctgctccgccagaaaacggacggtcacattgttgccctgagtcaacatactcgtcaaagtatagttctctttcattctactaagatcttttctgctgatctgagctgtatagactttcccttttgtcatttccaaaagctccgttactgtcccgctgtagtaaagctctccttcatccatgatggctatctgctcacaagtcgcctcaatatccccgacaatatgagtcgataaaatgacaattctctcctccgcgatttcgcacaaaagattccgaaaacgtacacgttcttccgggtccagtcctgccgtaggctcatcgacaatcaacactttaggctcgtggagaatggcctgggcaatcccgagtcttcgtttcatgccgccggagagcgccctgacctttgtccggtattcatcctgaagattcactttctttaataataccgggatcctttctttcctggtctgtctggaaagccccgaaagagctcccagataatccattgcctcatacacccccatatttggatacatggaaaaatcctgcgggaggtatcctgtgatcctgcgaaccttcgctgcttcctctactggaatcccacagatcgtgacctccccgctttgctttttcaacagggtagcaagcaccttcatcagcgtcgtctttccggctccgtttcttcccaggaggccaaacattccggaaggaatcgtaagggtaagatgttttaaggcatgttttcttccgtagtatttatccaggtctttgatcctgatttccatctggttttttctcatctgtctacttcctttcttgttgatatctctatcatacaagggatttccctagattttccctaaataagtgaaaggatttctttagatttccttccgaattcggaaagaggctgacaccacagccccatttccactgatacagttggtgtagctgacatctccgccatgtttccggcagagaatagcggaaagattcagaccgattccgaaatgttcctcctttgtaccctcgctgaaatacagatgggaggcatttaacagggcatcttctgaaaatcccagaccatcgtcggagacaaagagatacaatatgtctccttctgtttctgtcaatatttccacatgactttcagcatagcggttagcattagagagcaagttatccagcacctccagaaaaagatcctcgtcaagatacagcttctgatctttcatctgattccggtaacagatccttacctcttttgccatattgagggcgtccaccatccccaaaatccgggccgcaatctcagaggatttctttctgaccggatgaaatggaatctcttccaccgaacggagggatttcatcgtcccactgaagcgctccagccgcccacactgctcagccaaaagtcccagtgtatcctttaatttttcctggctgatcgttccttttggaaggtaacgaacaagaaaatccgaatacccgcggatcaccgtaaggggagtacgtagatcatgggcaaatgctgcattgagctgtttctggtcctccaccagcttccacatttctttttgattttcttccagacttttccgcatttcctcaaacgaagcgcaaagtctccccatctcatcctcactcgcataggagaccgtaaaatccagatccttcctgccaatccggtccacagccccctccaggatggcaaacggtttttttagccgcttccggtaaaaaaaggaagcaaacaccagcatcgtgatcactgtatacacaaatggacaccatttggaaatctcctgcaaaaaaatcatcccggtctgctcccaggccgaaagtttccccttctcatggtaataaacataatggcccccatcactggcgtacatagagtccatatccaaagcatttcgctctaccaggatgtccatccaccgctcgcagacctgggtggtagcaaaactcagcagtaatgcagccacagcagcaatacacagataggcaatcaacgcctttttgatcggaaggttccgaatccatatccgaaacgtttccattttttcatctacccaatccatttataccccactccccagactgtctcaatgtaatcttcctttgttttctgtgcgatcttcccccgaagcctccggatatgctccgtcacaatactgttgtcaccgtttccttccaacccccggaccgcctcgtagatctgctccttactaaacacctgtcttggatgcatggagagaaattccagaatatcaaactccgtctttgtcagacggatctcctccccgtcaaagcgtacactgcgttcatcgtagcgaatccggaaccctttcgtctcctcgctctcctttttgctttgtctgccccgcttctctctccgcagatgggccatgactcttacgcccagctcatcaatagaaaagggctttgtaatataatcatccccgccggagagcagcccgttaatcttatcctgctcctctatcttggcggtaagaaacaaaatcggacagcgcacctcctcccggatctttcggcacacactcataccatccagatccggaagattaatatccagaagaatcagatccggctgcttctttgccagttcgactgcctcccgtccattttccgccgtccaagtctcataccccgtcatctcaaaataatcttttaacagcatccggattcccggttcatcgtctacaatcagtaatcgttccatcgccctttcctccccgttgtttgaactgtcatacactttatagtatacaatatctttccctattttttccctattttctcataacacttcagggcttgtacatcctgtaaaacatgctataatgaaacataggaaaaattacatagtaaaggagaacaatttccatgaaagcttatgaaagattactaaaatatgtcgttgtccgaactccaagcgatgagacaagcgacactgtcccatcctccaaatgtcagtttgaccttgcaggcatccttgttgacgagctgaaagaacttggcgtggaggcacatgtggacgaacagtgctatgtctacggaaagattccggcaactcctggttatgaatcgagtccgaagatcggatttatcgcgcacatggatacggtttctgatttctgtgatcacgaaattgtcccggtactgcacccggattatgacggaaaagatctggtacttggagagagcggacgcaccctggaggtcagcgcattcccgcatcttccagagctaaaaggtcgtactctgatcacaacggacggtacgactgtgctgggagccgacgacaaggcgggtatcgctgagattatgaccatgatcgagcggattaacgaagagaacattccgcacggaccgatccgagtagcatttacgccggatgaagaaattggtaccggagcatcccacttcaacgtgccggaatttgatgctgattttggatatactctggatggagatacggagggcgagattcagtatgaaaatttcaatgcctgcaaggcagacttcgagatcaccggattttccgtacatccaggttccagtaaagatacgatgatcaacgcctccctggtggcatgtgaaatcaacaacatgcttccgggctgcgagacccctcgcggaaccgaaggttatgaaggcttctatcatcttgtatccatgagtggagatgtaggaaaagcagagcttcattacttcctgagagaccatgacgccaatatgtttgagtcacgccagaagacacttcgtctgattgagaaagacttaaatgaaaaatggggcgaaggtactgtgaagctgacgatcacccagcagtacaagaatatgtccaccatcatcaaagactgtatgcatctgatcgaaaatgcaaaaaccgcatgtgaaaatgcaaacgtacctgctcagatccttccgatccgcggcggtacagacggatgtcagttaagtttcaaaggtctcccatgtccgaatttgggaaccggcggacacgcctatcacggcccttacgaacacatcactgtcgagggaatggatctggcgacagacgttgtcatcgagatcgtaaagctttacgcagaacagaactaacatcataaaaaagagtatttctgccggatgtcaaattccggcggaaatactcttttatcccatcctatttagtgtgctttgaatccctctccaagcacttcgttggattccacgataatgatgaacgccttcggatcaatctcttttactatctttcggatcccgtacatttctttattgttgcaggcacaaagcacaacgtcacgctccacacgggagtaacttccctccgcctttaaaaaggtacatccgcgtcccacttcctgatcaatccgctccgcgacttctttcgggaagtctgttacaatcaaagacattttaccggcatcaattccgtacatcatcttatccacaaccgcggataaaaggaaactgatcaccattccataaatcaggctgtcaatatctctggaaacaagaagcgttccgagcaatacgacaagcgcctccaatgcaaaagaaatctttccaagggacaaatgtggattcagtgccttgatggaaagcatgatgaagtcagatcctccggtagacgtatttctcatgtagatcatcgcataaccaagcccggaaaaaacccccgtacagatcgctgccagcatccggtcgccagtgtagactggaaacatcggcgccaccacgtccataattacggatgtgataatgatcgtccgaatagaacgaataaaaaagtcttttcccagaatccggaagcagacgatcgccaccggaatatttaacagcatcgccaccgtaccgatcggcagaccaaacaggtgatagaaaatcagggcgattccgttaaatcctaccatcgggaactttgccatagcagcaaaattgtacgttccaatggcaatcagaattccccctataatgtcgatcagtatatccatgcccagtttttttgtatccagtttcttcatcacagattctcctttccagtatgtcctcactttacgccaaaaaaataacatctgcaaactataaattataattcgcaaatgctcttccagaaaatagtatactatttttctttttttcttgtcaaccccttttctttacttttccgttcaacctgactataatgaaagaaaaagatcacaaggaggtcctatatgaaactcgtctttctggacgccaaaaccattggctccgacatcaatctgtctgccttcgaaactttgggcgaagttgtctactatgatttcactaccccggacgaagccagtattagaagcagggacgccgacgtcctcatcgtcaataaaacagaaatcaacgcaaaaaccattggggaggcatcccacttaaagctgatatgtgtgactgctactgggacaaacaatctggacaaagactatctcaaaagccgtggcatcgcatggcgcaatgtggcaggatactccacagattcggtggcacagcacacctttgccatgctcttttatctgctggagaagatgcgctactatgacgactatgtaaaagaagaacgctacgtgagcgaccggattttcactcattttgccgaacattttcacgaacttgcctccatgcgcttcgggatcatcggacttggaaatattgggcgaaaggttgcacagattgcctccgccttcggtgcagacgtcgtatactactctgcttcccaccagccgcctcaggagggctatcatcaggtagaccttgacactctgcttgccacctccgatatcatctccatccatgcgccgctgaccgtccatacacagggacttatcaattccgctgcccttgagaaaatgaaaccatctgccatcctcttaaatcttggacggggaccgatcgtcgtggaaacagatcttgcaaacgccctcaaaaaggggaccatcgccgccgctggactcgatgtattaagccaggagcccatgacggatgacaatcccctcctttccatcaaagacagcaaaaagcttcttattaccccccatattgcttgggcggcaatagaggcacgaacccgtctgatggagattatttatggccagataaaagactttttttccatctcctgatagtctttcctatttctgccgcggctgcggctgctgcaacgacagccgctccgcccatcaaacaaaaatcccccagattaaaggtgatctttctgatctgcgggtccgccgcgtcaaatccgatataatccaccacatagccccgtttcaggcggtcatacagattgctgaccgctccggagagcatgagggatgtccctgcaaatttccattttccctttttggaaaacaaaagcttcatgtaatatatcagcaacagaattcctgctcccagggagcctccctttacaagcctatcctcaccgctcagcatccccagggcgaaaccgtagttgtgaaccttgcgaatccggatcttccccccgaacatttcctcttcctttgcgctgtccggacgcttttcgatgcggtctttccagaacaaatccaatgtcgaaagggcagcgcttatggtaacgatccattttttcatttgctcttattctcctttgatccggtcaatctccttttgcagatcctcaatctgctcctgtctcttctcgatagcctcgcagaattcaatacagcactcgtctgtcaactcgtgattttcaaacttttcatacacagactttccaatatccacatagtcacgctcattagcacgctctaaggtgcggatctgactttttaatttctccctgtcccagatctcattggtcttcttccctacgatatcggctgtttcagaaagctttttaccaagctcgtcaaaaaaatgatccattgtttttcctcctttataactgccggatttcctcaaaagtatgatacaaatccatggtaccgtacccccacaaccggtttgggtattcgatccctgggttcctcctcgttccaagaatcaatatattgcgaatttgtgaggaggaagcctgggctccctgatcctgtataatccactgtaaaagcagcgccgcgctccctgccgcaatggcaattccaacgctggagcctgaccgctccgtaaagctcccgccagggatggccccggtcacattgactccggggacggcaaattccggcttaatgttcctgtctctagtatatcccctgccggactgaaccgcaactgaattttcctcccagttatagaaagcggccgtaatcgcagacggggtgctccccggttccagcatcgtttcatccgggcttggccgcaggaaatacacctctccggtcagaaattctgagaccggaagccagatgtgaaaaagtccgtcaatgctctgaagcggctccagaccgatcttccagattccctccgccgggtcgataaaccgtaggataatcagctctgaattggtacgttccaccaaaagccggtaatcgatgatgaccgtcgtcttttccagaaaaaagcgatactcatttctactgttctggcggataggcactttctggatcatttcacctgatggcgagaccagagataccgccaggacattgggaatatctgtccagatctccgcctgaaatcctttgaccccctctcctacccgaagctctaccatctcccggtccccctggatcctcgtctctccctgatagtgatgacgcttatccgcctcgttgcccgtccccgtcactaccacccggtttctgccgttagcgtaattttccaactcctcgcagataggtgccgttccgttatgccctccgagactgcatccaagcggtacgcagatcacaagcgccctgtcgtatttccgggcaagctgatccaggtaataaagtcccgccagcatatcattttcctggaaggcaatcgctccctcccggataaaataaaaatcccgcagatactgtttggcaggctttaactttaccatggcaatcatcgcctccggcgccgcccccacaaactgattctccacattggcgctccctgccgccacgcttgccgtaaatgtcccgtgtccgtcctcgtcccttgtcggcacaaaggaaaacgggtcctcctgacgcaacgccttattaatatcttccctcgtataagcgctgccatagcagaaaccctcaggcggattcccatcctgaatcgtctggtcccagattccaagaatccttgtagagccgtccagcccctgaaatactgcgtttggatagtcaattcccgtatccagaaatccgatgagcatctcctgaccctttaattccagaccgggataattctggacggccgtaatccctgccgcattaagtgctcccatatcaaggggggtatagcatctgggaatggaataatagggaatcatgttttccggaaagcgatctgcctcctcctgtgggagatacacatttttatagtgtactcccgcaggctgggtcagataagttccctccctcagatacggtaaaaaacgatctgtaagcataaagtcccggtagtcctctgaaagcacggcctccctgcactgttcttcttccataaaaaacctacacatactttttatcagtatatgtaggtatcttctttcttatttcactttttacctgccaagccttgtggccgtattctgctctaacataggcacttcctgtcccctcagccggatcaccgggccgccggtaccctctatgtaagctcttgtaatgatgacttcaccgatactgtcatcctttggaatctcatacataatatccagcatgaattcctcaatgatcgcccgcagagctctggctcctgtatccttttccattgctttctctgcaatagcatacagagcgtcatcctcgaactccagacgcacttcgtcaagtgccagaagcttctgatactgcttgagaatcgcgtttctgggctcctttaaaatcttgacaaacatctcccgatccagactctggagtgtacagattaccggaagccgtcctaaaaactcaggaatcatcccaaagtttctcagatcctctaccgtcactttggatagaagattcttgtcgtggtcatatttgtccttcagatccgcaataaatccaatggaggactgcttattcaggcgctctttaatgatctgctccagtcccgggaacgctccgccacagatgaaaagaatattcctcgtgttgaccgtggtgagcggaaccatggcattcttactgttggctcccaccggcacctccacatcgctgccttccagaagcttcaacattccctgctgtacagactccccgctgacatctctttgattggtgtttttcttcttggcgatcttgtcgatctcatccacaaagataatcccccgctctgccttctcgacgtcgttgtccgccgcggcgagaagcttggatacgagactctcgatatcatccccgatatacccggcctctgtaagagacgtagcgtctgtaatggcaagcggcacatcgagaagtctcgccaaggtcttgaccagataagttttaccggagcctgtcgggccaagcataaggatattggacttttcgatctctatatcgtccattgtatccgtcaccacccgcttgtaatggttataaaccgcaacggagatgatcttcttcgcctgctcctgcccgatcacataatcgtcaagctttgccttgatcttgtgaggagccggaatattacgaagatccagctccggcgcctcatccttttctttcttttcttttttcttcttaaccttctgctgctttggcatcatattctccagatcctgcatatttaaaatctggactcccggcatccgcatcagttggttcaaatcgatctgcccgttattcatcagatcaaaacttttctgcatacagtctgggcagacatatagattattcggaagctctatcatcttacctgtcacgctctccgggcggtggcagatggagcacagtttctcatattctctgtcgtccttagacgtatcttctacaacgcctttgacagcttcttcgagtttctggtcttctgttttttcttcgtcgatcgttgtattcttttcctctgacatttgctaaaaccccttctatactgattttacagcacgttatagaagttattatagaccagatatcacgcccggacaagtaaagattttctaaactgagaagttactcttctatccactcttttaactcatcttccatcaggacgccggaatgacgttttaaagcttctccgttttcaaacagaaccactgtcgggatgcttaagatccggtactgctttgcaagctctctattctcatccacattgatctttccaattttcactgcatccgtcttctccgcataggaatgaagaatcgggatgaatgtctgacatggtccgcaccactctgcccagaaatcgatgagtaccggtttgtcagactgtaatacctccgtctcaaaattctcctgtgtgatttttaatacttctgccatttatgtttcctcctttttggttacggttcagccatgtacaaagtcataaaacctaaactcaaacttgctgcaatcgagccgtcatagctgaactgttccttttttcttttattatacctgattttccactgttttccgtaacaaagtcaccaacagatgcgcttagcgtagactgtccccggccagttcgtagagccgctcttcgtcgaggacgcgaatcttacctcgggatagaagcacaagcccctcctgctgaaaatatcgcagcatgcgggtgacgacctcccttgcagatccaagctccctcgccgcccggtcgtgagtaagcgaaaattccattttgcctgaattttttgcctcttcaatcagaaaagccgccaaacgcttatccacactttttccgagaatctgctccatcgtccacatcacatcagaaaaccgctctgccattagttcgttagtatatttcatcaccgaaagtgaagtatccatcagctcctgataggcgtacggcgggatcacccagtagatggtctcctcccttgcctccatccagatttcaaagtcgatggtacggaaaatacagcttgcggccagaaggcacagatcccgctcaaacatcctgtacactgtgatctctttgccctccccggatgtcacaaaagcccttagctgtccacatttaacgataacaaatcccaggcagtcagcgtttccccggtggataatctcgcctttcttcgcggttttgagtaccgcttccctcaggattttctcctgttgcggctggctaagctgtttccagaaaggcagatatgcttctatctcattttctgcacgatttcccatttttatccctcattttccatcatctttagaaaatcttcctccgaaagaatcggaatctcaagctcctttgcctttcggttcttggaagacatagactccgtgtcattattaatcaggtagcttgtcttggatgtgacagagcctgtcaccttgcccccccttttctcaatctcttcctttatctcattacggttcttaaaatgatgaactgatcccgtgatgacaaactgtatcccggtgaaaatctgtgcttccctcgtctcctcttttgtaagtttcacttcttttagaagcttctcatagccggcacgtctgtcctgatcctgaaaatagtctgtgaatgacccggcaatcacatcaccgataccgccgatctcactgagctcctctctggttgcgtctgccgttctctgcggatcctcgtcaaactgcttacagatcagtttcgccgtagctgctcccacattttcaatgcccagggcatagatcagccttgcaagggttgtctccctggatgtctcaatactgtctaacaagttttgacaagatttttctccaaatccctccatcttcctgatctcctccctgtgctgatccagatgatagatatccgcaaattcatggataaaaccttttgcgataaacttctccatcgttgcctcggaaaggccgtcaatattcatggcgtcccggctcacaaagagggtgaacgccttgatctgtttggcctgacacagcggattcgtgcagtagagtgccctggcatttaaaatctgccggaccttggtcctgccaccgcagaccgggcaggattccggtacgtccttcaccccgcttcttgtcagattttccgcaatctgcggaataatcatattggccttgtacacctggatcgtgtctcccacaccaagctccagttcctccataatactgatattgtggacactggctctcgatacggttgtcccctccagctccacgggatcaaaaatcgccaccggattgataagccctgtccgagacggactccactcaatctccttcagcgtcgtctcccgaatctcgtccgcccatttaaaagcgaaagaatcccgcggaaatttggccgtacttccaagtgactctccgtaggcaatgtcatcataaacaagcacaagcccgtcggatggcacctcgtttttctggacctgacccgcaaaccacgccacctcctcttccacgctttttgcggtcacgagatggtattccacagtctcaaatccctgttctttcaaccactccatctgccgtgctctggaattttcaaaatccacaccttcggcccgaacaagggagaatgcatagaaatggacatttctcctggccgtaatttcattattgagctgacgcaccgacccactgcaaagattcctcggattcttgtatttggcgtccacatcctcgatctcttcattgatcttctcaaaatcatcgtaccggatcaccgcctcaccccgcaggatgagttccccctggtacgaaattttcaacggaatatttctgaacactttcgcattgttggtgacaacctcaccgatttccccgtttccacgagtaactgccttatataaagctccatcccggtaagtcagaacgatcgtaaggccatccattttccaggaaatcaatgctttctgatcccccagaaattctttaagacgttccacttccttcgtcttatccagagacagcatcggccgctcgtgccgctctttcgggagctcactcaccacctcgtaacccacatgaaccgtcggactcgccgccaaggtcgtatgaagcttgtcctccagtgctacaagctcatcgtacagtctgtcatactcgtaattactcattatttcccgcgcctcctggtagtaagcgcgccctgcttcattgagcagtttcacgagttcctccattctccgcttcttttcttccagacttgcatctatctttgtcatgttcttggtctcctgttcccttttctttctctgcgaccggttgaacgcctgactttcaccggctgattggtggaatattccagcatactgctaagctcctccagctcctgctctgtaagtttccggtactgtccgggcttaagatctcccagtcggacccccataatccgcacccgctttaatgtgattacctgatatcccagcgcctcacacatccggcggatctgccggttgagcccctgagtcaggatgatccgaaatgtgcgcttcccttcctttttaatctggcatggtcttgtcacggtgtccagaatcgggacacctcctgccattttctctaaaaatgtgtccgtcatcggtttatttaccgtgacaaggtattctttctcatggtaatttccggcacgcatcatcttattgataatatcgccattattggtcatcaaaagcagtccctctgagtccttatcaagcctcccggcgtaggtaatcctcgtgggataattgagatagcggatgatattgtccggttcacgcttttcttcggtgcagacaatccctcttggtttattgaccgccaacacaatcatttcctcctccggtgtgatcactttcccatccaccatcacttcctgtccggctgaaattttcatccccatgacggccacttccccatccaccatcactcgtcctgcttcaatcaggcggtccgcctccctcctggaacagacgcccgattcgcttaaatatttattcagacgaaaggactccctcatggaacgctcctgaaactgtctttctatctggctgttcatacgattgatgactcccttttttctaaaactacgttatctctatcttacttagaacagccccaaaagtcaacggacgccccaaacaagactatatctttttttccccacttctgatatactgatacaaagaacaacaaaatttcttaacattatgaaacgatgacgcctggaggctatctatgatcagctacattatgaatacaaaaaactgcatgtccgtccttcttctgtccgaccgcttcgacagtttctccttcatcggaggggaaatcactacctactgcacctttcagatcgacgggacatatcacccggaattcttcgcggacaaagaagacgccggaagcgagccgtacgtacgctggagctatgtacgggaatactgtctttccctcatcaaagggaaacagacgcccctgcgtttccactttatcctgtccctttcaccggatcagatcgaagcactcctgcaaagagcagatctcccttaccggtccggcgatatcaaaggtctttacctcaacttccgctttgatggcacccgtctgctctgcaccaccggaacctcttttcacacatttgtacaggataagagtctggagcatctgtgggatggcacagtgatgaaactgtttgcgtccaaaggactggaatttgaagaaaatagttaaatagatagctttacatagaggcaggtgcgatttcatacaaaatcacacctgcctcgatctgttagaggtaaaaaatcggtattaccgacatcccccttttcattaaaaaacattttattttgtcagcatcaacatgatatcgttacttctcttgatgaagtctgtcatctgttccgggctgagcggtttgttggagagcattgcaagatcgtaaagctgctggcagatgatattgatgttctcgctgtctttattgttttcgatatactgtaccagtgggtggttgatgttcagtaccagtgtcgtatcgcttccaaacatggaggcgtccatgccgcccattccgtacatcttcatcatttcctgcattcttctggactcttcagaaagggtcatcatggatgcgatgttttcgtctttgatcttttccactttgacctgaaggttttcgttgttcatcgctttcttgacgatagaagcgatctcctcagcccgttttccaaatgcttccttttcttcctcaccgacttcctcttttacttgatctgtcacatctgcgtcaattctctggaagtggatatgctggtttctctgctccaactgtgtgataaacggtgcgtcaatgttgtgcgaaagtatgacagcatccataccctggctcttaaagagattgatatactggctctgctgctgttcatctgtcacgtagtagatcgtcttcttctccgtctcttttgcttcttccttgtttccaccgtcctctgtctttgcttcttccggtacttctccgatcagctctttcatggacagatatttgtgatccagattcttaaagagaatggagtccatcatcttatcacagaatttctgatccttaaggcatccgaattttacaaaaggactgatatcgtcccagtatttctcgtagttttccaagtcagtattgcacattccggtgagtttatccgccactttcttggaaatatactctgccaccttattgacgaatccatcattttgcagtgcgcttcgtgatacgttcaacggaagatccggacagtcgatgacaccttttaagagcatcagatattccggaatgatctccttgatattgtcggcgataaacacctgattgttatacagtttgattgttccttcgatagaatcgtactccgtgttgatcttcgggaaataaagaattccttttagattgaacggataatccatattcagatgaatccagaacaatggctccttatagtccaggaatacttttctataaaattcaatataatcttctttgctacattcgttcgggtgctttgcccagagcggatgaatgtcgttgatcggaaccgggcgcttctcgattttgactttctctttcgccggagagacttctaccatctctttttcaccctgctcgttttctttttcttccatcttggcatcttcgtgaatgtgctctacgacaacgtccgtatctttcagttcactctcgtcaatagtctcatattcgattggggcattggccttttccagataaatctccaccggcatgaaagaacagtatttctccagaacttctcttgcccggtattcgttcgcaaactgtaggctgtcctcatttaagaagagggtgatctctgttccgacgccctctttgctacctgcctgcatctcgtactccgtgccgccttcgctgacccagtgtaccggctcggctccctctttataggaaagggtatcaatgtgtacttcatccgccaccatgaacgcagaataaaatccaagtccgaagtggccgatcatgtcgtcctctgtcgtcttgtctttgtacttttccagaaactgagtcgctccggaaaaagcgatctgagtaatgtactcctctacttcttctgccgtcataccaattccgttgtcaataaacttcaacgtcttttcttccgggtttactactacatgaatttgcggcttgtagtcctcagaaaggttgtactcgcccatcatatccagctttttcagctttgtgatggcgtcacatccgtttgaaatcatctcacgaaagaaaatgtcgtggtcagaataaacccacttctttataataggaaaaatattttcactgctgatggaaagacttccttttttcactgacatgatatatcactccttcatcatctatcctgccggagtcagccttttacaatcttattataatctgaactgtctctccggcatgtctttttcacatctaactgttatcttaatacccgcctgcgaaaaagtcaatagaaaattagcactcttttaaaaagagtgctaataatacctcttcgggatacggctctcgcacggcacttttgtctgacattttccgcacccataccgtggagcgtacgtcttcttcgttgattccagaaatgtatcacatgggctatgcctctttcccccttccatagaaatcgctcctgcggggcagcgccgaatacacgccccgcaccgtgtacagtactcatatagatccgtatatttccgctttctcgcctcaaatgtttccgttacaatcaggctccccaatctcccggccatccctttctctgtaatgatccccttggaaagaccaaaagttccaagtccacagacaaaggcgacatgacgctcggaccagttactcgtataagacgcgtcctgccagtttcctactcttttgggatctggctttgtcacgctgcaaaaccgcccatccgcagcaggaatcacactctcaattccttctatcccaagtattttctggatctccttacaaaatgccattacaaaccgctggccctctatccgggcgtgcagccacaaagcggacggctccggtcccggagtacgattactgctcctgacttcttctgtaaaagggagaaaaaagctcatcacactgttcgcttttggaagccattcttccggcaataaaaactgcggtccaaccgcttccttctttttcagttcttgaaacatcggatctttggcgtccccatatccccagaccgggggatcaaagatccgcgccccggcaagttctggtgcaatcgcctcttccagagatacgacatttcttctgctttctgccacaaactgcgccgcctgcttttccatatcttcttttttcatatcctctgtcccctctcttcctttctggctctgctttcaaaataaaggaaacgctcaatcgagtccaggatatcccgaaactcctccctcggtgccagctcaatataacgttccagaaggtctgtctcctgctttttgtatcttccataaaaaatatcatacagattgtgtccccggatatgaatccgaatctcctccatgtgggctttcacatcctccactgtctccaaatccttccccagaacctctcgcagcttctttccactacggattttatgcagatactccttccatttttccaaaaacatctcataaaatgcttcctcggacggcacgaccccaagaagtgccataattttaggattcaaaaaataattttcaaaagaataatacttgaggatgagaacgttcttctccgtcacccgtggaagccggtccacatcttccagattccgctcttcgtaatactggcatagctgccgtttcaattcattcgcgtctttcccatccccatcccggatcataagaaaattgtcctgaagataaatctgattcatgtatttcaggttggcgtacgtcttaatattcgtacaactattggtggtaatgatcgcaatcctggaaagtgtcccgtcctcctcgtacgtctcgtcatagtatttcttaatcagaagcggcaacctgctcttatcctgtttgccctccacgataaaaacaaaatttacattcatcagatcattggcagaataccccagatcatccagcaccccactgatatccgtccgctccttcacttccgatgtaccatcctttccgacaagcacctgtcggatctctctgctgttgaaatttgccagcagattaggggcatgcgtcgaaaagatcacctggcttgttctggaaagtcggtaaagaatatctcctgtcactctctgaagtttcggatgcaggtaaatctccggatcctccacaaggatcacatccgtcccctcctcctttgtctcctcacatgtttccaaaagagacaacatataaatgcttctcattcctttccccatcgtatccatactccgggccatcttctcatcttcccggcagatctccgtggtaacggaaagcatcttctccagatcccggttcatggaataacggatcgtctcttttcccccgttcttacggaaattggcgttgacccgtctggaaaactcatccagattaagctggtagagcttatgctccaaaagctttgcagcctcgaaagcattgaggcttgctgtttccttcttatgaattaacccgatacaggagaaacaatgattgcagactttccccatgtcaaacatgcagttgccggccctcatccgtttgacaaggtcatcctcctgcatcagcaaaagatcttcctcaaaattttccagatcacgctgtgcgtcaatgtaatacagcttcgggagcagcatcagaatataacgattatgcttggaaatcccgtctccgtaccggatcttcccttcccggtttgccgtaaactcaaatgttacttctccgtccttaaaagagggaatcttcctgccaaaatcccggcgccacgattcgtatcgccgataagaactgacaataccgtgatggtacatccgctgtaaatcctcttctcccaccgtcagtgtcagcatgatctcaatattgggataatcctcccggaaatcctcttttcgcacctgataactcccggctacggcacgcaaggcatccagtaccgccgtttttccagtgctgttctggccaactaaaatcagcgcctgttcaatatcgggaatgtgaatttcccggatcgatttgaaattccgtatccggatatccttgatcctcatggaatcaccttctttcttcctactcctattgtagcaggaagcctccatccctgccagccataatcctcctccaaaggcaaagaagaaaggacagcgggagaaaactctcttcccacgctgtccgtctgccttcgtttcatctttgttttcttttatttggatatcgtctcccctgcttccaccgcattgattttctcccggatggacgcaaccgatgtgtcatccggcacaatcacagaaagcggacctccggaataggaatagcagtactgcgtggaagaagttccttccgccgcaacggatatgacgttccatcctttcattcccgcaagctgtactctgacaagctcctggagctgacttgtagacatattcgtctctgtgttaccactgacctggtcaataagacgcggtcccttaatcagaatcgatggagacatagcctttttcaacatcgcttcaatgactgcctgctggttctttcccctctgattatccccctctgccaaagcatgacgctccctgcagaaagccagggcttcttttccattaaaatgattgagcccttcctttacttccacaaccatgccggaatcattgcccgtcgtaaaggccagctcagaatctacgtcaatcccgccaaggatatctaccatctcgatcagagatgtaaagttcacacgtacatagaaaggaatatccacctggtaaagctcctccagggttgccatagaagtggcgatcccataagtaccagcatgggtcagcttatccggcgctccgtttgacacacccggaatcggcacatagtaatctctcggcgttgtcacaagcaggatctgctttgtctttggattcactgtggcaataatattcacgtcgcttcggctctgctgagtgatatctccatacacatcaatcccactgatataaacactgaacggttcttccgatacattcaccgcagcggcagcttcctttcggtcaggagcttcgtttccgtcggtgatatcattcaaagctgtacgcacttcaaacatatagtaagacgcaagcaacagcagagcactgatcagcagccccagaatgcctcccaggaacctctttttccggaatccgttctgcatccgaaaaatcagaagcgccagcacaagcagcacgactgccgctccccccagaaatgtccacgggatcattccgaaatagactgctgttcccagaaagactgccgtcgcaatcatctgaatcagaaaaatcagtctgccatgtaatcttttggtatgtctcccccctgccggacctggctcgcgccctctgtatccggaggaagaactgcgccttttacgggtaccaaatccgagatcttctggcatccgggtccgccttggccgctcctcatattcataatcatcatcgtcgtaatcattatagtcatcatatccatacgaatcgtaatcgtcataatcatcgtatgtatcatagccgcgactgcggtcatagctgtcataatcgatataacgactgcttctgcgattacgaatatcattctcatcgatctcattgccatcgtaatcggtataccgactcctggaacgtctgcctgacgttctcgtcgtattgcgggagctgctggaatttcttttcttagtagaactgccctgcttctttctcttcttcagggcctgctcgtaagccagtctctcctgacgactcattttagacatattacatcttcccttttctcttatttattccctcgttagattatagcccgtcccacaaaaggaagtcaaggacaagggtacactttacaaaatcaggtagaaagccggaaccctgataaatcccgtatttacgcaggtttccggctctgaatgaaattccgtttcacaaaatattaagaaagttgtcagatttttgtacttttatctggcgctgtcctcccatttccgatagattgcttccagggcgtccgtcaccccctccactccgagaagacttgcattgaacaacataccgtgtgcctcaatacttccccattctcttccggtatgggcctcgtagtatgtttttctgtcccggtccatcttcttgatcttatcccatgcctgcctggaatctaatccgtaaatcttcataatacggcggattctgtcctccttatatgcatagataaagctgtgaatacaattactgtaatctcccagaatataatctgcacatcttcccacgaaaatgcatggtccccggtcagcaagacggttgatgatactgctctgcacttcatagaccttatcacttaacggcaccgactcattactgtcgttgataaataccgtataatcccgcatattaaccacataggcagacaaaaactttccgaggatcgtctcatccaccttctccgccgcctcctgactgattgacaactcatgcgccgccatagagatcagattattgtcatacagcggaatattcagtctctctgaaagccggttgccaatctcatgtcctccgctgccaaattgcctgccgattgtaataatagtatgattcgtcatattcccacactccttttcccactctatagtgaaaccatgactgctactctctcttctttttgtggatctgaagctgcagattgaccgacatcggattgatcaccacgccctttgtctccggcgccagcagatccggaatcttctctgccggaatcactgccgttcgaaagcggttctccctgttaaacttttggaactccagtacgtcggtaaataccggctggtaggagtcttccttcttatcttttaaaagcggcactcccttgtccgcctcaaacgccacaatataacggcctctggagaaatgtgccatcacttcttcctgtaactgtttgacctccgattctccctcaccctggtgcagtctctgggtcttctgcatcaggtataatgccgtcaggacaagctccggattctctacacggatcttgccctccggaagttcttctgtatctgccctatgtacaatctccgaaagctggagactaatctcactttccaatccctggccgataacgacacagttgactcccattgcgtatagatttgagaaaaaccgcaggagctgcttattctccacttttacaaggcttacaggttccttttttgcagcaagcgccttagcggcattctgcgcgtcttccagtttcatgtatacgagaacctcatcatcaaatgtatccggatcacagattacatatggcatccttgtgcaggcagatgcaatcgtataaacctccggggccctctgaatattgcggatcgcctcctgtttttgaggcgtcagtgttccatttttcttctcatcactcatggtcgatcttgtcctttctgtatcattcctgtacagatatagtataaacgatttcccgaaaacctacaatttctttctgccctttcttcggttcctatttcttgatatgaatgtggctcaagaagatgaacagtgccatccccagtgccaggatgtatccaaaagccccaagcgccgggatcccccagattttgggcttcatatccgtggtacaaatgatactggaactgatcaaaagcgccatggccagaaatcccatgaccagtctctttacaatcctggaaagcatctcgtttaagtcgtccgcggcgtgcagatccaggttaatccggttctggcctttcagaaatccgtgcaggatatctgccgtcagtgccggaatatcgagtgctttgtgaagagaacggtacatgcttctggcatttttcttcaatgacttcttaaagtccttccccagataaaaatttcctgccatacgggcagcagcaatgtccaccatattgatctccggcgcaagatccgcaaggacaccttccatatgggtcagcccccttgccagcatcgtcagaccgtgaggcatccggatcttgttcttcttcatcacttccatcaaatcctgaatcacatccgccaaatcgatatttcccatatcggtagtaccgtacttagacaacaggtctccaatgtcccgatacagctcactctgatccggccgcccctggaactctcccagcgccatcaccacttccagaatcaatgccacatcattggccgccacaccctttaccgcctcggcgatcagatccttgtccctctcggtcagccgtcccatcatccccatgtcaatccagataattttcccatcccgtatccgcacattacccggatgtggatccgcatggaaaaatccgtcatccatgacctgcttgatataattgtccacgagcttcgttccgatctccttcagatcgtatccttcttccagaagacgctctttttcatggatcccaaatccatcaatatactccatcaccaggacatgggtcgttgtatattctttaaaaagagccggtgtcccaacaaaggcgatgtcatcattttttctggaaaactcctccatattggcagcttcgattaggaaattcatctcctcctgggtgacagtccacagctcgtccagcaccatatccagatccacaagtcctttcatgctgatcggaggcaggagccgtactgctttgtgaagaagaccaatgtcgcgggacataatatcgtaaatcccttttctctgcactttaacgacaaccttctcacctgtctttaatactgccctgtgcacctgggcgatcgaggcagatccctgtgggatcggttcaatctgctcaaagacctcggtgtacggacatccgtaagcctcctccagcacttcctgtaccttctcaaagggcatcggagctacttccgaccgaagtctcatcagctcatcacagtatttcttcggaagaatgtcggaatgcatggaagcaatctgaccaagcttgatataggtcggtcccagctcctccagaatcagtcgaagcttctccggagtcacgccccgggaaatctcgtgtttgtgaagcacggatgtaatctcttttaatcgttttccatacttttccgatgattgaccattcattgaagctattctgtctctcctttatcttcttctgtctgtttttctggcgtctccatcttcgcaatggcttctttcagatccgctaactgctccggtgtcatctttccaatcatctcctgcagctcttctggggaattcggtttgagagatacattgactttctccttcattgtctgtcggatattgtgcttaagctcttcattaagtactttcccctgctcgacagtcagttcaccttttttcaccatctcatccagaagttccttggatttctccgccgtcacagcgacggcacctactccggcaagcatcactttctttaagttttctcctaatccatccatatgtattctcctctcttatatcgtaatcagatccatgtaacaacatgtggaacaaaaatcagcacccccacaatcaccgaggcaatcgcagcgatcagaaccgctccggccgccgtatctttggcgatctttgccaaaggcttcttctcctctgtcgccagatctactaccgcctccacggctgtattgacaagctccaacgacaggacgagagcgcacatgatcatgcaaatacaccattctaccacagtcagcttcgctacgattccggcaatcagaaccaaaacaagcgccatacagtgaactttcatatttcgctctttgcggattccggtccagatacccgaaaacgcatatccaaaacttctccacagcggattttttctgtcacccggcatattcatcatcccctatcttttgttcccgtttttctgctccactaatttattattattttatcaaagttctcacaaattatctagtctttccctattattttttttattttcagaatttttatttttttcaaatctctattgataaaatgcaaagaatcgtgcacaatgaaaacatctgacaaaccaaaaaaaggagatttgaaatgaaattatatattgcttatggcagcaacctgcacaaacaacaaatggaaaagcgctgtcctgatgcagttccacacgctgttggaacgctgaatggatgggaacttgtctaccgcggagtcaatccgaacagaatctatgccactctccaacaaaaggaaggagcctctaccccggtagttctttgggaaatcacaccgaaagacgagacaaatctggacgagtacgaagattatcctacgctctactataaacaggatattcccgtgacacttactgatggaaccaccatactggctatggtttatcttatgacggatcaggccacacctggccgcccttcggacacctatattcagacgatccgggaaggatacgaagactttgatctggatctgtccgtttttgaagcatctctcaagcacggatgctgttagaatagctataaaaggaaaggagagatcacactggaactatttaacgccaaccgttgtgccatagagctccaggccggccgacgggtaggtcagcttgtgtttgctaaaatggatgcctgcgctctgcatccgtacaacgggaaataccagggacagactggcgccaccgggtcaaaagcctttctggatccggacagacgcaaagaataggaaatctgtcgtttatatggagaagagaatgatatatgaaaattttactttatttctcttccccattgcagtattcccacagagatcagaagaattccaccgatcatccatgtcgtctcaatggaaaaccaagctgccagttttcccataataagcatggagatatagttgaagatactcactatcatcgaatgaaaagatagaaccgttgcacggtttccatgactgatttctgtgtttaaaaccgtctcttttaacggataaatcacaccgaggaacgcttcaaaaagcaggattccgatcagcagactccaaaacgtatgcagaaatgccagtccaagtatactgattccgcaaaatgtacttgttatcgcaagggccaaaaaggatctgcgctttactctttccagcaccgcatttccgcccagcatcgccacccggatcagaacccacgcaaatccgatgatcgtataattcacatgttcaaaccgatgaagcattggcgaccaaaatacaaataccggtgaaatagcgaaagccagaatactgttaaataaaataatattccagactttcttatccttcatacaatacttcacactgtcctttataatgagtctgatgcctgctatggcctctgatacactccgcttttctttcttggtacttatgatctccaattttggcatcactgctaaactgatcccgatataacataccgatgagatcaatgcaaacagaaagatcccctccaggaaccagtccgcgataacacctccaagcagccctgaaaggatcatcataatggaaagacatttgttcttcttgagaaacaccgtcttactctcgctgactgatgtatgatcaatcacccatgcatccaaagttccggattcaaaagcgcaggcaaaccccaaacagatctgtgcagccagaaatgccatcataccatttccaaagaaaaacagtacattcgtagctgccatcaaaacaccgctcaaagctgtcgttttcacataaccgatctgatccgccatcgcccccgccggaatctccataaaaaagactgcgatcagagacgttgccaccacaaaattcgtctccatcgcatccagccccttgctgtacaaaaacaaaacaaacgtcgctcctgtgatcccggcataaaactcaaacagacagttcagaagaagaaaggtacttctgacttttttgcatctgatggcctctgcttcctttcctctctcctcttccatacgccctcccacctcttttaggataatatggcatcgattatatcacctttcgtcatagaatactatggtatttttacgttttcttagcccctgcttatgttctctccttttcctctgttttcaattcccgcaattatccggatcaacactgttcccaaccatgcacaaataatccacattccgtatacgagtgccccatccttgtagcataagcggattgcctggtacgtactctgattcgcccagccgtctccggcaaagaattctttaactgtatctatgtagaagctaatatccaaaatctgttcccgcggcaaaaattctcttgggatgttcagcctgcctgtcagataatacacggctgccatccagacagcaatgatcgccaccccctgcagtccctgcagccagttcttctcctgcagcgcccccagcttcctgatactcaaaaccagcaacatcatactgagtggaatggccgccgcaagccatgcaagtcttcccatctgcaaggcaatgcttctgtgagcgctaagattcatacttttgccttcgatcggccggccaaatagatccctggtgaaatcggttactttgcctatcagaaccgctctttctttctcacccctgacctcatagatttcccttccatgctctcctgcgcccacatttttgattctgtatccctgtatctttgccgcttctatttccgccgtttccagaggctccttcagttgtaacaaaacgccttccggtaaactctcggcctcattcttgattccttcactgatcaaaaaattcattaccacaagccccgcagtcatcacagcagccgctatccatacaatcagacgctcgattccttttcgcttacgttcccttttcatcactcttcccccgcaatcacaactacatcgtcatcctccagaggccatgtggaataatttacgattttccttggcctgagctgatcgtcaaaaacggaactcttcggaaccaaagacatattcccctcttccatcaatggatcactttcctccttctgaacgacccactcttttccaaacagtccttcccgctcttctgcaaaaaataaaacaaaagatccattctcttcctgtttataacaagatagcggaattttgaccatatctgtcattccttcttcttcacattgtacggcgcgaactgtttctacttcgatccgcatcattttctcaatccgtaaagacaataccgtgcagataacaagcagtaaaaatacagtacatccggctatccatactttctttttcctcatgtttcatcaactccaaagcacatctcgtaatccatccgtcagttccttatgatagtacaggaagaagaatgtcaccggaagcagacacaaaagtccgcacacagactgaaccgtcatgctgttttccatcacacccgccagaaaaacggaaagtggataatccagttctccctccaggaaaataatcggctgttccaccatgttccagctctccacaaatgtcagtacaaataatgtcactactgcgggctttgcagccggtacgacaatatacctgacaatctgaagctggtttgcccggtcaagtcttgccgcctcaagccattcatccggaatagactgaaaaataaaggtcagccacactgttccaaacggggaaaaaatccccgggataataagcgatttccaactgttcaaaaatcccagcttttccatcagaatataatttggaagcagtgtgacctgcaccggaagaatcataaacaaagccatcatagcaagccagaacttcttcccgataaaccgatatttggcaaaggccgtccctgccatacatgcaaggatggtctgtcctccagcaatcaaaagacacattccaaggcttctccagaatttcaccagatatccggggctttcaagaagcacacggtaatagcccatcatggagactcccgcatttttcccttcccacaccgaacagatcaacatatagattaccggatagagaaaaacaagggagatgattccaaggaaaagaacacgtttctgtctctttttagccatactttttcccccttctcacaatcagataaagcacgtatccaaccactgccggcacaagaagcgccgccacaatactgaccgcagcagcagaaatcttctgataattcaggttctggaaattattgttcataaagtgctgcaacaaataaatactgtcatccggataatttcctcccagaagaaaggcctcccggtaacatttaaacccattcatcaccgaaagtacaatggtaaagccaaaggtcggaatcaacatgggccatgtaatatgccaaaacgactgccatttcccggcaccaaacattgtcgcatattcataatattctcttggtatcatctgtagtctggcaaaataaatcaaaacataatacccggtgaaccgccaacaatacagaatacacagcacccagaatgccgccgacgtattcagccagtctttcggttctcctccaatcaactccaagatcctattccagataccggactctccccataaaaactgcacgccaagaacgactgacgcaatcggcagaatcatcggatacagaaaggacaactgaaagaaccgcacgccctttaccgcattttgcaacagtatagaaagaaacatggctcctgccagcgtcacgggaacagtcacggccatgtattggatcgtatttttcaccgccagaagaaacatctcattttcaaacagacttttaaaattatccagccccacaaactcacgtttcccaatgccgaaagatacagaataccagaccgtaatcaaaaacggtacgaaataaaatacgagaaatccggccagtgccgggaatgccagcaagaatccattattacgctttctcatcttcctgccccctccccactttactctgacaccagtttcttgtagatgttccatgtggtatcagcaatctcagagatcttctgctccatttgaatcgaaggctcatatctgtcgaaaatcagtgccgacaattccgtatacagattccactctgcctccgtcataaaatagacattctcgatttctctcaggcactccactacttcctgggcaacatgctcatccgctgaactcatccagttttgtaccgcattctcctgcaatggagctccggaaaaatcaatccatccgtccaaaaccggaagctccctgtcgtgcttttcttccttatatttgcgtgtccgttcattgagtaacagcataatcagctcatatgattcctccttgtaatcactggacattcctaccgccccataggatcctaccgacgccaccttgtgcccattcatgtcaggaataagccggagcgttgttcccggttcatatccaacactttctataaaattaagagagaagccagatcctgactcttctatcattgcatccgtactttccaagaaagaaacccattgcttcacaaactctttccattcttctttgtcaaagaacacttcctgattctcatagtcaaccgccggctgcatccaccgtccggcgccctgccatatacctctgaatgccattttctgctgaatatcagaagatgcctccgcctgttctatccactcccatagggtatctccctccatttcgtctataccggatttctgtgccaatacaaaccaatatccggacagcggaatgatgtactgtcgtccgtcaaaccttccagcttttaaaaaagcctcattatatgtgctgttctcccagtaagtatccccctccatatactcatccaacggagccagagcaccactttgcatcgcctgatatggattttctaataagtaagatctcacttcggctatattatcctggtcactctctaacagatagacatccggcccctttcctgccatgatctctgtacgaagcttctcgatttccgtctcccgctccggcccctcacccggaagcgtttgaatctcgacacgaatccgactgtgaatcccctccataaatctcgccgccatatccaccttgtcatataaacgttgatccgtaatgactctcagcgtctttttctcctctttctctccgcatccactgaaacctgcagccagagacacaaggcaaaccatcgctgtagcctttctgaatcttttcctctctctcatcactttccctccctcctcatgttatttccgactgctattatctaaattatatcatttttatcaattatcgtctatcattaatgtatttagttgatattttgttataatatttaattattatatttattttttcattattcaccagctctttaattttagttatttcagaatttcatcctcctcagtatttatcggagtttattttaccttgttaatgtcacaagaaaaataccattcaactaagggaaactgtatgatttttgtcaaaataattgtatgtcctttcacggatactggttctgattcgacaaaaggaaccatttctccccattttcataccctgataatgaagaaatgaatctctcaaataaaaaatacaggaggctttattatgggtattacaagttctaacaaagaaatcaacagctcacagatccgttgtggcgggacattccgtgtcacacttgcactctccgcagctccagatatttcggaaaacccgaccgatatcgttctagttctggaccgctccggtagtatggctggaagtcctctggccaatttaaaacttggagcaaacaccttcatcgatatcatcgatgagagtaccgacagtacacaagatggtcagattggcttgggaagccgcattgctattgtaagtttttccggaagtgcaacggcgaatacgcagcttatcacatccgtttctgatttaaaatctgctgtcaattcactctccgcaggcggtgcaaccaaccatgcagatgccttttccactgcaatgtccttgtttgatccatcctcttctaatgccagggtgatcgtcatgttcactgatggaaagacgactgccggaattccacctgccccgatagccgaagcgatccgtgattccggtgttgtaatctactgtatcggattaatcggagataatggtatcgacgtagactccctcaatgattgggcgacagatcctgacacttctcatgtcgtttttactccggatgagtccgaactggaggaactgtttgcagatctggcagccaatatctcaaaaccaggagcaacaaatatagtaatagacgaaacattgaatccatctttcacaattttgaacgtcagcatcccctcgaccggtactgctaccaccattgactctcattctcttcaatggaaaatcccgtctcttggcgtatccggaaatgaaggcgcttctttagaattttacgtccagcataccggtaagacctcgggcactcttccggtcaatcaatcgatctcttatactgatgacgaagggaatctggtaactttcccagacccgacaatccaggtagactgcggtactgtagtcaaccctgaaccttgccctgtacctattgactttactatcggaagctgtcaggattcccttattgtagatcttggcgatacctgtctggaatcttccggccggatcgtacagttaaatatcactttgaaaaacgtctgcccgaaaaaacgggttgctcttggaatcatcctttcggagaccgattcttacggtcaagaatatccgcggggaatgaaaactatcaccgtaccggcacacagtcttacggggtgtcaggacgtggagatccaatgtatcaaattcattttgccagaagatttaaccccatccgaaaattcctgtcgttcgctttgccacgaacggaatctgaaagcccggatcatcgctcactacattgataccgattttcagtgctgtgactcaacggttacgttctaacataaaaaacagaggaaggctctttttgagtcttccccttgctttatcgcagaatgatattgtcattgtttctattcttctgttaaaatagtgacctctaccgtaccttttgggcaatctgatgaaaaatgattcctattaaaatcaaatacgcatagttcatattattgtatagttaaaacttagttagataaacttttcgcataaaaaaccaagtccatcccctttttgatattttctatctttcctgtcctggtatagttcatcttttcatacaaatgacacagctttttttcctgtaggatcgtgtccagttcccatcttattgcttttggatacaatgcttctacagcattgatcgtatcctgtgcatatcctttattctgaaattcaggcaaaataaagatttgcttgagcttacaaagcgttccaaaatcgcatacacgaactgcccctattatttcttcattcagttttatcatccagtaatcagtttctgattgttgaaatcgttcgtagatccgttctattttttctgcccccggattcgtctcataatcctgatatttttcaagtagttccccaaacgatcgaatttggagtcgatagatatccgggcaatctgaaaatgttgcccggatcagttttaacttcatatttttctcctagtaaaatttctgcctgtccatatcaatcataaatctcttttagaacctgactgatatttcggcaataatcggtttctcctcttctgtctatgtaaatccttaagtgcatcttgaatgtcttccactgtctgaatatcgtattctgccagtagctgatagattatgttgagatttccttcttttacgtgtatccgatggacaggtttcgattattttgccgtaatcaaagacctcctatgatttggtatgctgctttttaggtagacacaaattgcttaaaatatttttttgtaaattcatataatccaatccctgtggcaattgataggtttaacgaatccacctcgtgaagataattaatcaaaatagattgtccaatttcggaatatgtatctggcagtcctgttgcttcatttccaaagataagcgaaaaagctctatcaactttcatttcaatttcgtaatcctgcaaagcctttgccccatttagcatgaatgggaacatatcatgggactctttatatatcgcatagtaagtatcaaacgaatcgtatcggcatatatttacatgaaaaacagctcccattgaagctctaacaactttgggattaaaaatatccactgcaggctctatcacagccaaattttttataccaaatcccacacacgttcggatgatagttcccatatttcccatatcactaggattaactaatacaacatgattcgaatctttatctaattcattgttgtatttttcaaatacacctattacaaaacaattttctttgtctctaagcttttctacaattctatcgttacattcaaaaaaaatattatttgcattacaaatacctgtaataatttcctcctgtgtcacgctatttaaatcggaatgtgtaaaaactttcatcacttttttaggatatttttttaaaagttctattgttggaaaagcccctaatgtataagaatacggcaattttttattatattttttcatttttatatttgatatcataatacgctccactgtttctcatctatttttttactcattttaattgttctaaacgaaaatataaacaaaaccatttttcaatatcaaattcatttccaataattccatctacgtacacctaataattgcagaaatacgggatattaaagaaatgtttttacataatagctcttacgatatttagtaaaaaaacttgcttaataactttaacacaaaatccgataaatttcattcttttttgtttaattctgttaacattaaaactatcgatataccaagtacagctaaaatctcaaatgcccaatactcctcatagtttcttaacagaatggctatacaaatccaaagagcagttctccctagagcattttttttggcaatatccttttcactgctatccaatttctttgcaaacggtaccggcgcaaatttatatatgattaacagataaacacctccaataaacgccatctctaatcgattacatctaataaagcttaaaaatttagatactaaaatagaaaacgcaaaaaaaatgttataacaaacgaaacaccctccatatgactttgcgtgatatcctcctaattgagttctcacatttcctaatatgagaatataaataaccccaagaataggataacctaaaaatgcagctacactaattatccaaatcgaattaaaaatggatgtaagtaataacctaattccatattcataaagaactttctcttcgctttttattatttctatttttaataaatttttcaccaaattatttactattttttctatcatttttcttcttataataattttaatattaaaatatgggacattcctgcgaaatccccagggaataggaccactatattctttttttgctgtatattctctgatcttaacaattctttcctaaaaattatcttattctcatatattcttaatttaacctatatttaaaatagttggtatttatatgaattacctattttagtttttaatacatatcacaaaaaagtcattcctctttcctattttgtaattgcagagattccaacggtatcatcacatgaacacaaaaattatcttttaattcaaaaacttcaaacattccatctatattttctaccaattctttaacatgctcaatccccaatccatgttcttctgtatttttcttatttgtctttaatcctttattattctgcaacacagactgatttatcttatttttaactatgcaactgacatattcatttttcattatcatttcaaaatatacttctctttgctctactttcctttcagcctcaatggcattatcaagtagattaaacaatataatgctgattgcaaatccatctattgtatcgtactcaccaataatatagctgtataattcaatttcattctcatgacaaatattaaattttgaatttaatgtcacatcaatcagtgaatttcccgtaaatatatattctttactctcttttatataataatcatcaattttctccaaataaactagactctcctgtatattgccattctctatcaaactttttaagtttaatagtgtattcctataatcatgcctaagtctacgaattcttttttcagaacgtttaatttctttaatttgttgttcttgacatatattctgaaattgtaaaatttttatcttatcttcttgatacttttgttcgctaattttacatattgtaaatacgatataaatatctacacctactgcaccacaagaaataaatagcagccctaaatgatatgtatttatataaacatcgctattcagtaaatacaaaattaccccttcaaccaagatggagtaccataaaatcaaactataaataatacaatatcttttattcaagaaaatcttgattctttttccatattttaatattattgatgttataataaaatatatagttaatacccctgctattcctaagtaataatagggattatgaatatctacatattcttcgaaagacacacctccaatcaaaataattatttgcaaaaaatttacattaattaatgggatcaaaagcaacgaaattaatactataatactatgctgtattttatttcccaacaaatatttttcacaaaatataaacagtatcacaaaattaattaatgttaataatatgtcatttatatttaataaacttcccaactctaatggcaaaaaaatcaatacaatgcttatcaatctttgccgcgctacatgtccccatactgatttagttccgaaaaatttgataagaaagttttgaattaaaaatgcttgtacaaaattacaaaaaaatatacaaaagcccaatatcatcctaaatgctttccctccaacattgcatgaaacgttccttacactcttttttcttttcacgacttatctgaattatattattgtcttccataacaatataagaatcttcaaattttttagcatatcttaaatttactatcgctccactatttaccctaaaaaaagattcttctttcaactgattgaggcactctttcattgtccctcgaaattcatatttctccgtcgtacttgttattaattcaattttatgttcccaataagttagatacataatattttctattggtatacacattgtggttttgggggtttctaaaagaaatgaggaacattttttactaactcggtatataaattgttctatcattttaggaatttccgtttcaacatttttctttcttataaaagcgaatggataacattctaacgaacgaaaaactaaattgtcataacttgttatgaaaacaatatttttattccttccctccttttttaagtattcggcaatttttatacctgatatatccggcatttcaatatccagaataatcaattcgtttttaaattccttgttatattccagaaatttccttccgcttatgtagatattacagtgaaattcaatcccctttttactcaattcatattctatcagtttttttatttttcgagctattattacatcatcatcacaaatagaaacataaatcatatgccattaccccctcttcttgtttaaaatcgtttatgatcatataagtgttcattagcttggacgaatatctttcttcgtgccaaactcaaacatatgtttttcccattatcttttaccagtctcgttgccttattccttgacttaaagcatgatattcttacctataattgaatatatctccttaaattattttgttattcttatcttaaagacattgttccagatgagaggggcttatgagttgaaatgtctaaaacactttttctaagagccctaaaaataacattatttaggaggcatgaaggtgaaaatatattagatatattgtactataaatgagataaaaagtattcacaaattttatattctaatgcttcgcattcttttaataacggaaaaattctttcaaaattatagtctccgaccttgttcttcctcatagattcctttaaatataaattaagtgcaatttttgctgtgttacttaaatcagaaattatagattcaatataatcagaattgtttaaatactccttctcagaaaagtattgatatcgatactcccacattttactgtgagctaataatagactaaaatgccgtctaaccattggagattgaagtatatttttccaacattctattccccagaaaaaagagtctttatcattattttccaaaaccaaacaggaatcatattttgatagtaaattagtgcaattcaaaaaatctttaatagattttttaaagttgtcagagttaaatgtatatttctgttgagcattatattttaaaagaataatttctgtataattatttaaataatcttctatattaaaccccttacattgaggaagagagcgaaatgattcattcatttcatcataagaacactcatacatggtgtatatcccgttataaaaaaaatcatacatctgaacggtccgtgataatgtatctatattagtaatgatcggattatgatcatcatctatctgagttttatatttatgaataggacgcatattcaagatagaataaacataaaaaccatctttaagacaggactccaaaaaatcagtgtaattggtaaaattatttttgacaaatataaacggaagagtatatgtatctataaaaggacaaatattccaaagaaatttaggaaaaaagtaatccgcaccatttcttttattcatatatacattaataaagtttgagtatatccaatcaaaagtatcaggataattttgtaaaattcctaatatgcaattatcaaacggtacatgtgttatcataggaaagttaaaaggtaaatttgtcttcatagtaatcttatgctcctctaatgtaaaaacaaaaactaatagtatctttaagtaataataaaaaaacagcaataaaatgtcaataataaaaggaaaatattatgtgaattaaaaaaatattttataaatgtaaaagatgatgaaaatgtttattaatataggaatctgacaggaataaggcatatttttaagggcaggatatagtcacattatagtcatatagaaacgctaatatcataaaagtgcaattgctagagtgttattgactttagcaactgcactgattttataataatagagggagtaatttgtctgatgtagactctattgaatattttattcaccatctccctccaaccatcccccaactataagtattcggttaagtaatttaagttctcattcctatttttctttacatgttaatttgcaatactactatattttcgaatcgcttttttaaaaacgattctcgctcctccaaaaaataaaataggtgctactatcccccatatttgtgttccaatattcagccttcccagaacaaacagaggcggaaaatttgaaacaataaatataggaataataaacgtaccaaaaaattttaatgctttaggataaattgccattggcatcatattaaaattggataatcctgaaactatctgactaattccttcacttttaacaaaccaaaaagacagtaaaggtggtaacaaaagaatactgtaaagcataacaactccaagtataatgtaaaacacatagcctgctataatgaaaggctctgttgataattgaagtgttttccatgcatttgataccataataactcctgcaataaagtttggaataggtactgcaagatctattgtagaaactgtaagataaaactgcaatgaaattggtttcgtaattgcaatatctaggcttccatcataaacactattttgtagatttgtaaaattgaacataaataatgcaccataaactgcagaaataataaaaaatgtaccagtaaacatagtaatcgcttctggtttcagtccgtccacaatcatatcagtattatatactacaactgtatataacaacttcgagaataagattaaactttctactattaaaattgtaaaaaaactagtacgatactccatttgactcataatataccgttttgtaaacaatcccatcaatcttaaatgttttgtaaattctttcaatacttatccccctaccgcaacatattgtagcaaaccacgtttccacaaagatctagttaatacccctagcacgaaaatccatataatctgtattccgattccctttaatgctgccattaaaccgattttcccagtaattatattgaccgtgaaatataccatgtactggaaaggaagcaattgaaaaacttgaatgatcgtttctccaaaaatatcaattggaaaaatcgcaccactcatcatatcaattaaaaaccgagcaccaaagaaaattccccatgcatctgttatccaaaaggaaagcatacttaaacaacagaaaacgtaaaaactcaaaatcaaagccaatagtattgctactagaaagagtacaatcctttctatgctcattgctatatgaattttccaactaaaaacaaccagtacaataaaaataaacgccagaataagctccatatgtattgccttttgcccaataaaactgaatagtttatataacaagtagttaaaaggcttgataatatatttgctaagtcctccagtttttacgtctgccgatatttcattttccactcctgtttttaaaaattttgcaatcatttgtgagaggattgtatacaaaatcatttggcttaatgtgtatccatatactatttgtttttgtgaattatcaaaaattgcaatccacaaaaacgtttgtatgatcataggaaaaaaggcgctaaataatacaaatataaaattcaatcggtactcatatgcactcttcattcccattctaaaacagcaaaaatattttttcatacttaaaactccagtcttgctatttaccggtaaagtaattcaattcctttttctactggaatatccgaaatacttatatctttaatattaagtttttgggttacataaccgataaattcatgcaagttttctctattgacttccattgtacaattcagtccatctttttttgtaattacaccgaatttacctaacttcatatcgtctatttcgcttgatagttctaaatttacaattttgatgtccttaaacatataattaacatcgcttaaacttccatcatagagtttttccccaccgttaattacaataactcgttcacataaatcctcaatatctttcatataatgactagtaatcattacagttgttttatattgttcattccagtatcgaataaaggaacgaatttttttttgggacactaaatctaagcctatagagggttcatctaaaaatattaattgcggagaatgaattaaagaggctattaattcaagtttcatcctttcacctagtgataaacgtctaacctgtacatttagcaaatgttttacatctaaatattctgtaagttcgtctaaaagcattttgcattttctttcatctacttcataaatgtattggtttaatcgaaatgtttctgaagcaggtaggtctggccataactgacttttttgccctaacaccatagaatacttcattttaaattccttctgccgcttccatggacaatatcccaaaacatgtacttctccgctagtcggatataaaattccactcaacatttttaatgttgttgtcttccctgctccatttggacctaaaaatcctataatatcaccactatcaatatcaaaacttatattttttacagcttctttagttttttgttttctaacaagaagatttttaagtgagtgctgaaatccttcctttttttcataatatgtaaacactttattaagatttttgactgatatcgcattcatgcatctcacctcgtcttattagtttgctgctgaatatagctaaacaaagacaatatatcgggaaatttcgtcatgtccaatttgtcatcttcaaatatgatattgaattcatcttctacttttacaattaaagaaataaaatcaattgagttgatccccatttcttgtaaactagtgtttaagcttatctcattatattgattattcaattgatgaaaaatccttgctaatttttcaaattccgggttctctacaactactttttctgtaatgttttctggcataactgtaagttcttgaatgtgcgatttcagaaactttctatctatttttccattgattgtatattttaattctgttatttgcacaaacttaaagggaatcatatatgccggaagttttttactcaagaacgatttaagttctgtttgatccaacttgttttcgtatacataataacaaattaaaccatgatctccttctggaaagcatatgcattgaagttcagaatcatagctgcaaatagtgttttctacctcttctatttccactctatatccccgtatttttatctgattgtctaaccggccaatacattcaagctctccataagaattcctcttacaaaaatctcctgatttatagtatctgacttttccatcagaggaaaagataaatttttcatctgtaagctcttgattattatagtatttctctgcaagacattcacctgaaatatataactctcctgtatcctctgtatcccctacaagtttatatgaaacattcttcataggctgtccaatgtgaacacggttactttctgtcaaatcagctataaagcaccaaacagtcgcttctgttggtccatacatgttatatatctttgctgatgtcttgttttgaagctcatgtaataaatcagaagggaaaacttctcctccaaccaaaagtactttcactttagacaaacatgttaaatttttgtcatattctctaagcatacgcaaccgtgatggagtcatttggataacatctgcacaatacttttctatataataactgatcattttaggatttgactctattccatccgctgttagaacaatagataaaccacaatgtaatgcataaaatgcttctaatacaaaaatatcaaacgaaactgttgttaggcaaagcattctcgaaacatcttttaaatcaatcgcttcatccaaaccatcaaaaaaatttagaatagagtgattagttataacaactcccttcggattccctgttgatcctgatgtatatattctatatacatatttgccactttggggttcaatgtaagatttttttgtttcgcaaagcttttcgatttgaactgtcgttttcccatggaagtgttccttattagattcgtctgtaataagaacacttatatcactatcttgaatgatatagtgaattctatcttcaggcatcgtcacatctaaaggaacataactaattccaagcatattaactgcaagaatcgatgcaattaaatctggcgaacgacttaacaaaatacctaccgcagattgggtatcatctatataatttttaagatttgttgctattgcaattacacgattgttgagctcaagataactaagttgtttttgttctgtacatattgctaccctatcaggatacctctttactgattcataaaaattggtatataaactatttcgcattttcttcacctatttgtcctgcaataatgaataaacataatctgtcaacgatttaacactctctaataaatccgtatttaacttttcttctggaattgcaatttcaaatgcatcttcaatcataattatcaattctaatgcgtcaatagaactatacccatactcttccaggaacaaattctcattactatctaattcctcaacttttttgtctaactgcaataattctataaaaattttctttatctcattctcaatgtcttcatatttaaatttattcatttttttctcctaaactgtaattatatttatgtacacttgaactttctttacattagatcttttttattttgatgctaaattaagttctaaaaatactttattttatatattgaaatctatctaataatgtagcgacaacctcctgatcatcctggtttgcacgaccaaaagattctaaaactacccagccagcaaatccatgatccataagttgcttatatactttttgaaagtcaatcaaacccttgcccggttctacaaattctgtaataataccccttagccttcttatttttacgtcagaaaaatgtacaatttgaattctgtctttcaaacaagatatccaacgttctggcatcccagaataaatagaattgcctgtatctaagcatacttttaaagccggcgaatttattttttcaataaagctcaacacatcatttggataacataatattccgctaatactattttccaaacagattataacatctcttttttgagcataatctgacaaggcggtgaaaaaattcatttcattttgtacggcttctttatagcctacaaactgcatgtttttttcgtcactacagtgcatagaaatataaggaatttctaagaaagaagctacatctatcattttcttaacaatttggacaacttgcatattcaaggttccggagagcgtccaaaattcttgtccgcttagcaaagttgtagacatagccataattttcatcttattctgtttgagtagctttaaaacattttctaaagacgcaggagtgctttccatactgatagctccactttgtgtaaatcctgcctcaaagaaatttatattagatttctttagtacgtcaatgatatgttccattgaagtttccccttcaattccacccttaaatataaatgttgatggtaaaatcatatcattcctcctttctaagcatgctgtatgcatgtgggatctgcatatccagtatttccgtaataattataagtcgccgcaatacatccccccttgcaactattatattctttacatttggaacaaggttcttttgtttttaaatattcttctctctctttaataaactgaatcttttttgaaaacttttcttccattccttgaactgattcttcttttatattcccacaatgaaagtcctttatatttacgagccctgtacatccggtaatatctccatatgccgtaattacaatactatttttaaatgcaggacatccatgaaatggatcatattgtacatataaagaaatattatttgaagttactactctcgtcttaggtatttttaagctctctctccagaggcatcccggtaagactaattctatcgaaagattcttttgaagtttcgtatttttatatttttttacccattcactgacgatataatatatcttcatataatcgtctttttcaacattatggtttacattttgttgcttttcaacaacatcaatgaacctgagtagctgcaccctactcaaattcattttttttgcaaaattcaaaagttctataaccgtactctcatttctgcttgttatgacactattaattccgatcccatcataatttaagctttgtaataattggataccttttactgctctttcaaaagtcccctttactccacgcatttcgtcatgtatctctttattgctcgaatcaatagaaatttgaaaacggtctatcatcgtaataacttctgctattttacttagttctttttcgatcagcgttccattactaacgagataaatttgtgtatctctataggatttaatatatctgattaaatcatatataaattcacataataacggttctccgccactgatatcaaaaatccgtactcccataccatatagtttatccactaccattttgtactcttcaaaggttaattcctctttcatacgttcttgtactattggcttatgagcacctgagtaacaaatcgcacactttagattacaacgcattgttggatataaaaatgctctcttagcatcgttatgaatcattctactaattccctttctctaattattttgttgcattttaactttcccaagctgagttttttccaacttatctgtgaacgaaatgatcttgggaatttttattggagggagaaatctgctgcagaatttttttaggtcatccgcatctatatcttcttgtactacaacgagagcctgaatggcttctccgtaccttggatgctttactgatctaactagaacctcctttacgctctgatgctttttgataacttcttcgatttcaagaggattaaccttgactccggccaaatttatcattcttttttctcttcctttaatatagatatatccttcttcatctatatcaacaatatcacccgtgtcataccattcaccttggaaaagttcatctccaacatatccaattcctcttcccttgctttttatgagtgaaattccatctataattttgatttctactccagtcaaaggtttccctactgattttatattgctttccagatcatcgcagagattaatcgcaatggtaccgctttctgtactgccatattcttgatgtatcacttttcctgtgatattgtaaaattcacgtgcgatatcggaatccagctttgcacccgcagatatacatattcgaagattatccaagttgtactttttcttttgtaatattcgattaaataatcggtacatatatggaacaccatgaaaaactgtaatctttttatcctgcaaaatttccagcaccttgcgtggcgtaaattcattaacgacttcaatgcacgcaccaatacaaataccttctatcaagcagcttcccagtgcataagaatgataaaaaggagtcacacccattaatgtatcttcttttgtaatacttacagttctttggtaattttgaaaagcttcaaataaactttcatgtgttagaattacacctttaggccgtcccactgaccccgatgtataaagtattaatgcaacatctgtaagcataatatcaatagaatgaacgaaattatctacattatcttcattaataatatcagaaaataaatcatctgttatcttttccaactcattaacgcagatccccttcacatgaatatcattcgcaagggcggttaatcgaattgaattttcatcaataatttcattaatatcgtatgaaagttttggatcagcaattactggaaccctttttgctaacatcgccccaaacaataacacaataaatttgtgcgaattagggagcatgattaaaattttatctgaactgtttgattgtttttgcaagtaagaagccatattacatatttgcatccatagtctcttgtaactaacttcgttgtcaccttctctcatacatattttattaggcatggttctaacattttgtaatagcgtactaaaaatagtcattccctaattcctccaccttttttaaacatgcctctaaagtttcctcactgtttagaatactactaatcatttttgctaattgttgaatatgattagactgaaaaatatttcttccgattgcgactcccgaaaaaccatatgtaattgcttgatcaattcttgtcaataattcttttacattatttgaataatttccacctgccaaaactgtatgaattcctgtattggaaatgcaatcttccaaatttgctaaatcgccattatagctgatttttactatatcagctcccatttcttgcgctacttttataaggtgtgatgtagtattgggatcattttctgccccttttgcatacatcatggccaataatggaattccccacttttcacactcatttgaaacatatccaaaatctttcaacatctgcgcttcgtcttctccgcccagattaacatgaatcgatattccatcaacaccatacgtcaacgcctcttctacctgtgtaaccagcacttttttctcactatatggagcaagagctgtagaagctgataaatgcattatataactatatgaaccatatatattttcctctattagttttttaattgtccccttatgagcaataacagcatctactccgccgctcgcagctaactttacagtatcacaatacgaatttattccctttattggaccaagggtaatcccatggtcaattggcagcaaaaaagtcttatctgaattataattaaaaagacgtcccattctaatttttttactcattacgcacctctgacactcatttattcttcttctaaaaactcatctattttaattccaacatgccttccgccttcgcaaaaatatgctaataattcatctccaatttttatggctgaggcattatgcactttcccctttggtcctaaaatacgaatgtgccaatcatcctgaacgattacattaatcctttttccagactttgattccacttcaatctttagtaatggccgtatttccatttttttccttccgacacttaccgctcgtcctcttccctctgtatttacagccattacttgcatacctgatttcagttctgataaatatatggtttcatcaaaaaaccatgtatatgaatgaactgcccccgcattaactcgaaatggtcttaattccatataagggagatgatgagtttctgaacttatcaatattcctcctgttgaagtggatccgattaacattccttcattcttatctaaaattgacgttgtatcaacgcatactctgcatcccattccaatatgtttaatatctactacttttccggtttctaaatttaactgcacctgatttgctttttcgatcagtttactcatctcctctatttccatcatttcccgtgatgtaaaaataatgccgtcacttcctttttccataaccccaaatactatttcagcgtcttgcacattatttacaaatttcattaatacacaattctttttttgaaatgccgcgataagcaattcaagcggaatatttgtcgtttcataaaacaacacacatacataatcataaaaagcgccgtttttatagacatattctaaatcatctttgtttgtaattactttaaataatgcgcttggtaagcctttttcttttgcttctcttaaaatttcttcgttttctgaaaatataattacatcttctaattcatccaactgttctattttctctacatgaacagcaatcgacattctttttggcaatatttcttttttatacaattcaggacgaattaacaaatgatcaaaatttttttcaaataccagacttaaaatattattatctaattctaaatctcttgcatcaaaccaaacttctctcttcttcatagcaatatttcctttctaagtgaacaacttgtcataatcaatctcttttaatagatacctgcacatatgaacgatttcctcatctttatgctttttataaaaatatgaaaaagctttctttaacttttcgttcaaatcatagcgataatgtgaaatatgataattcacgcactgatcggagtaaataataggatactttttgcataaccgatatcccaattcaaaatcctcgcagccccattcctttcctaaattttcgtcaaacccacctgcctctatcacccattctttagggcaacagaaattccctcctgtcatacctatccaatgatatttgctttcttctctttctaaaattttatgaattgtttcttccataaacgaagtagtcttataccttgcaatttttctttcaaaatcattgaaaatgtcttcaaccgatatacatcttttcttaaaattgtccattttcctgctttcatctattgtttcatatagaatacctttagatggatctttaaaataagccaatggaaaaatatcaattattttcccatgtacacatcttggacactccttttgaagtagtacatgatttttcaaatattcaggggaaagtattaagtcatcatcaacgaaaatcacaatatctccttgtgctttaccaagaccttcgtttctggctgccgatctccctttattgtcagataaatgtaatccccttattctaaaggggaaagattgcgtttctaaatactcttttgttccatctgaggaattgtcgtttaccactattacttcaaaactgcttctgtcaatggtttggaagttaatggaagctaaggtcaattttaatctaggaagtttattgtatgtaggaattatcaaactaatcatctttttgccttcttgtatctttttgaataatgtaggaagaagcagtacaccctccatacttacctgcttgttctatatgtttagataattgttgttttaagtacaaccgcttttcacttttccaaagatccactaaagttttttcgtataaatttccaagcgataaggaaggatcattcttcattgaagcacaaccatatacgttaagtttaggatctatatacaattcttttagctttatgcaggcagcacattcgtgtatctcaagcataatgttaggagttgcgaggattttttctaaaacagcttttccatatgaatcattcaaacaatgcttgtatatcttgattgtaagatataatttttctgaatagtttgggaaaatatctaaaattctatccaaagcttttaaatatctaaagcggaaattctcatcattttctttacgatttcctaccatgatcactggagaatacttcactgatattgctccaaaacgataggcataatcaatcatttcgtctattgtatcaacattttcttctgtaacagtgcaggaaatactaaccggaagtcgttctgaaaactttttaatattttcacatacagtatcatggttaattccaattctagttctttcatttatttctttatcaaacgaatccaaagatatgtctactgcaaatccgctttcatataacgctttttctatattttttgaatagatggtcccatttgttgatacaaaatacatcggcaagccttgccgaactaaaatttttttatactgcatgccgaatcgttctgcgggcaactgcaatttcagcaggttttttaaatcattgaaatatttagctggaataactttcttatattccttcattttgctcaaaatatcaactatatcttttcttataagaggttctcccccctgtaagacaataaaattccctcgaatatcaacaatttgttttatagtatttaaaacatcttctgtggatacttcatcaacttgtttatttaaactttctcctctacaacaatatatacactttaaattacatcgattagtaatatcgaatactgacatttcaattttcctccatgacacttttaaaaaatcgtttttcatcttccagcagagataagaccgactcatttaatgtattaagactctgttgcgataatcgacgagaaatttttattaagatataaacaatgttctgccatcgatatataaattcttgcactttttctttatatacagtgccaactccagatggatattcatcaaacgccttaagtaacattttacgagctggtataatagaatcaaattgtattttaaagcataagcttggtatttgttcatagatttccttttctgaaaacaattctgggagtctccttaaatcattagcaaaaatggatagctcttcgtcctcaaaattatttgattctatatgaaattttttattattcgttgcttgtaaattagaaattttttcactttctaacgatataattgtttttttaaaagcagaaaacgcgttccaaaatacttctttttcgatttcacctacaaataatgaactggggtgtgtcggaacaaagcagtcactaattatataaccatttttagtaacatctaaaataactataaaatgcttatttgtatatccggtttgataactagaactgtaatttaaatagtttgtcataaccgcaactaagacaggccggaagctatccacctcattttttatataatttcgaaactcatcctcattttcttgatattcaataatttggtttttgatttggttttttaaaaagaattttttataaattttaccgaattcatttgttaatcgaatatctgataaaccttgtccttcttcaaaacggtaatgtgttttaaaatagccaccattaaaaaagagatttgatgatttgatgttagggttataataatttacaacatttgctaaagacgagaactgacaatgtacaccttgatctgtctgatataaatcttttaacttttgcattttgagtcctttatctttcttctatttttcctattttcaacgattagttagttttattaactcaaggatgaaaactatatattttttatatatgaatctaaaaagtggatcggtatatcaaaatttttagctccattaaatataatatcagcatatatttttgttgaaatagaatatttttcttcttgatactttgcagactctataaaataggtagcaatgtcatccattttcatattaaattctttcatatttcgttttatacgtctataaagccttaattcaatatctgtatcaatgaaaatttttaattgcagtatttctcttagtttattaatggaaaaaatatttacaccttctacaataattatttttgcactcgtcttcgtagccttctttaaatccaccaaaagagcgtcgtagtcaactgattctaagctgttccaatcatcgtactccctttgtgtcaatggcgaaatcattttaggaagtttgtttttaaaataacggtcagcacaaatcaatataacctcgttttttttatatagttttacaaattgtttgcaaaaaaaagattttccacttccagatccacctgacactccaattattatttgctccatagtttttctccctttcacttatatatcaaactaataaatataagtatgaaaaactccttacatacttttagcaattcattacgagttctcatatcaattaacattttaattccatttcaaccttatcattaaaattaattatagaattaatataatagaatagttggtatatcagtttctttcttatactttgcatccatctaataaactaatagtcagtccctcattggtaacgccaacttgggggaatacactatttcaaatcacggatgttctgatcaagacgaattttgacaatgctgtttatctttccataaacaaaaaaatgcgctcaatgtaatccttattatgtttacataattgaaagcgcatacgattttctacgattgcctattatatccagactattcgtttatttatcattctttttttcatttttcttttttgctaaaatagtcttaatatcagaatctggaataatctcgtgaaatccccagtaggtaggccatccatccccttgctctgctgtatactcacttacctttgcaacttttgttaataaaatttttttcaagtccatattagcatcctcatttctttttaatatgtaaaaataattaattattatattagtttattacccatttttcttcaatatatttgacttaatctgtcatttttcgtgcttattctgtacaggaagattgaacataacgtaagaaaacgaagtaaaatcttgtattgaaagttctgagggattaaagctttcttaattttacccggaattattatatttacacgcttaagttatttattagaaataccactcatgcactttctataaccaaaacttcgtcacttatccagtcaatctcctgaaattatttcattttttgtccatacatttttcactgaatcctaatagcgctcttatcattagttccctcctctagtttaaaaaacctaatatttattattgtttaactagtaaaaactgatctgcctttagttaaaactttgtttttaatttttaaattattttatttgatttacaaaaattatattttgtatttcattgaaactaattatcagttatgctatattaacaaataagaactatttaacatgaaaaaggttttcacatattttttaaaacttctttgcataactttagtattatgattgtgaattatatactcttaagatagtatatactcagaaagatgttataacgaagccgttgtcccttgtgataatgtgaacaaagttaggatattaatgaagttgatacctcaaagatatgcgtggcccgaaaaagggaaggaagaaacattaagattatttttatggctgttttcctgattcatacaacagctaaactactgactcattatcttgagtttcttacatattttatttacagccatcaccgtacagaaatcaaacaacagtttttcttgctatgccctaacagcttaagcaacaagaatggaaattcccttactacccctaccggacattttttacaaatgtcttgtaagagaaaggagttatatttatgaaaaaaattttaccttttagtaatccaactattacatcatggacttggaccgctgcaactttttccattttaggaaactatcctaaatgtttaccttggctatacaataattttatacaattattttgtgaatgttacgaaaaatgggtttctttacattatattcctcacgtagatgtattttctgtctgtccattttttcattcctccctaatacctcgtacattccttcttgatcttaatataagtcttaatagttttattagaacttgtattaatcacaattattatgtctattgtataattgacgaatcctatattagtaggaaaaaacgatttttacacgaattactgatttatggatatgatgatttaacacagacatataatattgctgacttcaccctaacatcaacccaaaaatatactcaatcgaccacctcatatgatagtataaataaaggttatgtttctattagaccacatgaagatggattaactgatggtttaggtggtataggtggaatttatattttttctgtcaatccaaattataattatgattttaatatagatttaatgaaaaactatctgaatgattatattttcggttctgacagcggttatccttaccgtacctataatttaaaacggcaaacaggatctaataccggtttgcaatcaataagctatggattagatatttacgacatgcttcaaaaatattataaagaggtgaaacaagaagaaaaaacttttttcatacaaccgttgcatgtgctctacgatcataagtatttgatgctacaacgtttattatatttaaataaagaattaaaatttaaaattcctaatgatctcctggaagaatattctatgcttttttctgaggtaaatattctccgtaatttgggaataaaatactgggtttcaaggaaagtttctgctttagatacagtaatatcgcgtatacctggcataaaacaaaaggacttatatttgactaccaaacttataaaccttttgtaattgaggtgtattttgtcaaataatcagtaaaaaaagatcgtgggactgtttctcgtcccttaccacacagaataactaaaaatgatcaggagtttgccaaagtttgtgtaaaccttcaaactgatgtaagatagacttaccagtttggaggtttattttatggcaaggaaaaaagataccccacaaaaagcagcccttcgggaaatgatgggcaactatctgaaagaaaacaatgtaaaggtcaaggatggaacggatgtcaattctatcatgcgggatatgatatccatcatcctggaaggtgccctggatcaggaaatggatgaagaattaggctattccaaatatgattatcggaacaaggaaacggataattccagaaacggccattcccagaagaccatgcataccagttacggcgatatggagatcgatatcccaagagaccggaaaggtgagtttgaaccgcagatcgtcaaaaagtatcagaataccgtcactcaggatatggaagaaaagatcatctccatgtatgccaagggaatgaccacgaatgatatcgaaagccacatgcgggacctctacgacatcgagatttctgacagcaccatcagtaggatcacagataagatccttcccattgtaaaagaatggcaggaacggcctttggaggaaatctatgcagtcgtttttatggatgccatccactaccatgttcgcaatgaaggcaggattgttaaacgtgcggtttatatcgctataggaatcgacatggaagggcataaagacgtgctcggcatgtatgttgggcaaaatgaaagtgcgaagttctggctttccattttgaacggattgaagaatcgcggcgtagaagatatcctaatcgcatgcgtagacggcctgacaggctttccgcaggcaattgaggctgttttcccggatactgagatccagcagtgtatcatccaccagatccggaatacaacaaagtttgtttcctacaaggaactcaagccgctgatggctgatctgaaacgtgtatatgcagccccaacagaagagatcgcattagcagaactggacagctttggtgaaaaatggagcgggaaatatcctaaaatcgcaaaatcgtggaaggataactgggcgaatctttcaacgtatttcaagtatccggaagcagtccgccgtttgatttataccaccaatgccattgagggatttaaccgccagctccggaaggttacaaaatccaagaccgtgttcccttctgatgatagtctcttaaaaatgctgtatctggccatgatggatatcacaaaaaaatggacaggccaccgacaggattgggggcagatccattcgcagctggagattttctttgaagaaagactatccggattataaacagcttcctgtttgagagggctggataagccggccctgcttgacatgtctggaaactgcattataatacaatcaagagcagaacctcaaaaaattggtcctgcccaaagtaactaatgacatatcttatatcagtttttttcgtttacacaaaacctgaaacggtctcaaatgatcggttattttactttatccaataaattttttattcccagcgagcattaaataaacttcttcaaaagcgtatttaagttttgcaatacaacagggaagaaaatcgattttttgatctatgacttttattctacaattaaaacgaatttacactcctatctaattcgattcttggacagaaattgcttaagttcgcttttaccaaaatttgtgaatcccaatttataattggtagaaaacctgtttacatagaatatgcaaatacctctaaactttataattcttatttttctgcacagtttgttcaattaagtcaatgcaaacgtgacatgaatgaaatatctgaaagccctatattagttcaaacactaaaatattctctcaaatcccagaaacaggggattgtttctctaagatcatttccctgtttctatgcctcttattatgttaccatcaaaactgacccgttttttatttcttaactaaacttagcattcttctaattcatattaacttaattatgacgtatactagattttgtaaaaataattttttttaagcgaaaaagatatggtctgcatccgtttgatagaattaagtcacggcaacaacctcatcataggatagctatagaaccatgtccgataagattataaaactaagtaaaaacataacaagcacgatttaaaagatctcatttgtaacagtattgaaaaagctttaaatcccctgctcgctaaagaagctggcggagctagtcaatgtggagaaatacgtgcaatctgcctgccgtcaatggtatcgttctggtcattacgagaagagtctccatacaacagcaggcgaagtgtaactgaaaattcgcaaactcaaaggtttacctttcgaaacggcaataattaaatgctatcgacgcagagaatcttctgcggaagaatgttttctttcaggcagcaatcggcgcttttcctaatggacagagtactttaaatctcgtatgtgccagactgttagttaccatatgacaagattttacttttgcagaaactcatgtcattgtcacttttttcaacaacccaatctacttccctactatttttatagatccattattaacaacaaaccagcttgtagaccggactctgtataaacacttaatgtcttactggtaatatctttaccagattcatcgattcggaatctgggctactattatactttactaccgctttttaatctcacataaggctcatctaatctttcttcataatttctgttgtctttgtctactccaaggccaaatgataataatctgccgttcctctaattgttgatttttttaaatatcctttatttctatcattttcttttcctctttcgctattacgaaacatttaatcaaaatatacatgcaattaagatgtatttctctattacaaattatctaggagtaaaataaccatccagaaaatcgaaccagatataaatatcggtcacaatatctgactgtgaagacgcaatacaatcataacgtaagagcaagttgttgcacacgtatagctctaggggcttgaatttctatacgcgcttacgccaaacttgagacaaatagaatgaatataaataataatcaacttgttgctctcagaaaaaacttatttgttattaatatctttgaaatctttaatgatcttcctctttagtaaaaatacttacagcataaaagagaggcacaagaaaatctgtttctaacaatgcttgtcctcttaaatacagagtccttctgtattaatcatctataaattcattcaaagaatactttcggatttcgcacaatgtataatgtttagtaaaatcaatgttggacataagtattatttttctaatttatcccccctcaatcaaatagcacaatcaccctcattaactctttcctcactcataataatgaaagtttttgtatgaactgtcgttatcgcagtctgtaactggttccaaaacaaaattattcattgggtataaggcataatctaagaagctttcaaaatcaggaaattatatatcgtgctacttaatctgaaactctcttaattcaccttttcaaatgtctttattcaaactaatatcgtcgtcaggtaaaatgcccactctcaattatacattgcaagatagcattctttctctctaatataatattttattatcttaaggcactatccaagtttctattgtaagcactatggtattcccattgcaaattaccaaatatttgttattgtgtttttgattttattcttcagcaaactcacaaattaattccattattttaacgactaatctctttttgtcgtcatcaaaagtattaaaaattctcccaagttcattatctatctttcctctatattcaccatataaaatataatctgcatttgtctctaaagcttctgctaatctatacaatgtgtctgccgaaaaacctttttgtccactctctatttcatataaaaatttaggagaaatatctgccatttctgctaaatactcccttgtataatgtctttcttctctcaaaaatcgtattcttatacctgcatttttgtataattttttcatttgtatttccttccttttttctcataatactttgatttttaagttataaaaaggaacaatatgtatttattatcggcactattattctatatagtacgttacataaatatcttttttaaataatatattagtagatataattaactgtcgaaactataaatatattaataatagccttttttatcttactgtaaatattaaaatatccctaaatacactaagaggcttatcaactaataaatttttatcaaatagagacgtaaccacatcgaagtttaacatataaagctcagaacctaaagtaatagtttaaaaagttaatatatggaaaatcaggttatcaatttgtttcttatcttttgatctgtgaatcagcaaaaatactgaactatgtaagctttaaaaacaacagatacatgcctcaaccacaatattaaaagtacttaaacaaagaccatgggtatataaatcctctctatgttataaagatacaatatattctttactacaaggaattatcactctaaaattcggaatcagccatataggggaagcagactataattcatgctccatacaaagatctaaacatctagaatctcacccttattctgatcattgctataatcaataaccccagctcggttaaccccgatctgctcgactgtcccattcaatatgtataatgatatggagtttttgttcattctgttgaatataataagaaaattttgaacacagaagtggtcatcatcggcaagttacattcttccaggtaccctttctaaaaacactttttatatgcaccattgcagaacaattctttatagatatagtaatctaacatcctggtgttagatcataaatagtacaaaataaacatgatcattttcaataaatggtatacgatattcatagatcagggaggagaatggttatggcaaaaagtgctaaatattcacagcactttaaagaagatgcagtacagtttcgacttaaccatcaggaattaccacttcgcaatgtggcatagaatcttggaatcagtgaatccgcactgaaaaactggatgaaatcagctccctgactgtgaaacgccaggtttctgtcagcggaatactgaaaaatttaggcgtttcacgttcgggatataatatatggaagaaacgggttccttcggacacatctgttcgccgtgcagtttaaaaaaatccaacggtggaaaattatatacgtcaaatgggaaccagagctcaatgagtgaaaccgtatatccagacaactatagattctgacttcagccagaaactcaaaaatatcctcaacgaggactttaatcctgcgcatccggatgccgcttggtgttcttatatcaactatatttggacatttaaaggatttgtgtaccttaccagtgtcatagatctgtattcaggaaaaatcatttcctgggtgcttagtgagatgttggaagcttctcacgtagtggagtatattgaaaaagcaaaacatgttagaaaagttaaaaaaccattgattttccattgtgacaggggatgtcaatatgtatcagaagcatctcaaaaagcgaccacagggataatcctcagttattcaaagaaagcatattcatgggataacgcctgcatggaatcctcccatgcactcttgaatagagaatggatcggatccaccgatttaaattacttaattatacacatgcatatagattggtttttgaatacatcgaaatattttacaataccgtacacattcacagtcattgtgtatatttgtcttcaattaaatataagaagcaatatcttaaaagtatggagaagaatgcaataaaaccgagacggaggtgcggacattctcttggactaagctgttaatccaaaactgcgcctgtacttcataggactcatatatcctaatgattttttaattcctgtttcattataccatacaagataatcatttaatatatctataaagggagtatcccaaaatcctaaaatgaaattttaaattccaccgtccgcttatgcggtggaatttacctccgcacagttgatatttactctttcatacagaaatgttatggttatctctccttctgacagcagtagaaggaggaacattatgagtaaatatattcctggtaaccagaagcatcttactcttgaagatcgtatttatattgaaaatgaattgaataaaggtacatcttttaagaatattgccaaattcttgtgcaaggatcctactactatttccaaagaggcaagagcacacagattgtctgactggtatcacaaaggtactttttataatgcgaaaaacttctgcatccatcggtaccattgtaaaaagaccaattcctgcggcaagattatcctctgtggggtaaagtgcgtttccttccccacttgtaatcagacttgcaaagactttgtaaaagaacgctgcagcagactggataaggctccttatgtctgtaatggctgttacaaagaaaatcagccactgtacgattgcacataaatacgactacaacgcaagttttgctgacaggaaataccgcgaaaagctccgggattccagacccggtattaacatgacaaaacgggaattacaccagaaagataaagtcatttctcctctgatcaaacggggacagtcttcttatcatatcctgatcaatcatccggaattagatatgtctgtccgtactatgtactcctatctcaatcaaggactgtttactacacgggacatggatttaaaacgtaaggtacgttttaaaccacggaaatgccataaaacacagatcacaaaccggacagtttttgccaatcggttatacagtgatttttgtaacctggagctcccatcctatgttgaaatggatacggtacattcctccagggaatccaaaaaaactctgttgaccctgttctttacaaaagaaaaactgtttcttgcttttctcatgaaccggtgtacggaaggctctgtgcgccttgtttttgaccgcttagaaaaacgcttgggaacctatgagttcgcctctgtattcgagtatatcctgacagaccgtggctcagaattcggagaccctgtcgcattggaaactggtgtaaatggaatacagcgttccagtatttattattgtgacccaatgcagagcggacagaaaggcggactggaacaggcgcacacgatgctgcggatgatccttcccaaaggaaccagctttgaatttcttactcagtgggatgtaaacacgattgtaaaccatatcaattcaaccccaagagaaatccttggtggaagaacaccgtacagcatggcaaccgaaacatttggggatgagattctaaaagcatttcagcttaggccgatagaacctgaccaggtcaatctaacacctaagctgatccgctttaatcactaagcaactatctcaaaaatctgctgtcggactggaagtaaacttttcacatttttttaatgtggccggtggaattcagtccagcacactgattctcagtggcccgtttgccatgcccaaaaacaaagatttatttgagaagttggcataattatagcagatatcgatgttttttgctttattaaaacgcgtaaaaactgaaaaatttaaacccttgtggaatttaatcatgcactggaatttaaaatttcaagtcagcagtatcccaaagtttgtatcttacaaggagatcaagcctttgatggctgatctaaaacgtgtatatatgcaaccccaacggaagaaatcacattaacggaactggacagctttgatgaaaaatggagcggaaaatattctaaaatcacgaaatcctggaaggacaactgggcgaatctttcgacttattttaagtatccgtaaccggtccgccgtatgatctatactaccaatacagtcgaggatttaaccgtcagctccagaaggtcaccaaatccaagacggtatttccttccgacgatagtctcctgaaaatgctgtatctggctatgatggatatcccaaagaaataaacaggccaccgtcaggattggggtcagatccattcacagttggagatctttagtgttaggatataaatagtacaaaataaacatgaccattttcaataaatagtatatgatagtcatggatcaagggaggagaatggttatggcaaaaggtacaaaatattcccaacagtttaaagaggatgcggtacagtatcgcttggatcatccagagttgccacttcgcaaggctgtggagaatcttggagtcagcgaatctgcgctgaaaaactggatgaaagcagcaaaggaacataaaggcaaggttcctacccgcggttctggaaattatgcaagtgaggaagcgaaagagattgccagattgcagcgccaattacgagatacgaaggatgctcttgaagtgttaaaaaaagcaatcggtattctgggaaactgacaaaagctctttacacggctgcttctgagtacgtgaaagaaatcaaatccctgcccgtgaaacgtcaggcttctgtcagcggaatactgaaaaaattaggcgtttcacgttcaggttacaatgcatggaagaaacgagttccttcggacacgtctgttcgccgtgcagttttaaaagaaaaaattcaaaagatctatgaggaatctcatcaaaactacggtgctcctaaaattactgcagaattgcgaaaatccggggagtatgtttccgaaaaaacagttggaaattatatgcgtcaaatgggaatcaaagcccattgggtgaaaccatatatccagacaaccaaagattctgatttcagccagaaacttaaaaatatcctcaatgaggaattcaatcccactcatccagatgctgtctggtgttcagatatcacttatattgggacatttgaaggatttgtgtatcttaccagtgtcatggatctgtattcaagaaaaatcatttcctgggtgttgagtgagacgctggaggcatcccatgtagtggagtttcttggtttcttcttaggaagggctagaccgtttcaagtttttagtaaactaagatcataaatcttcgggagcgatagtactatgaaaatacgaattagagatttaagaacctccaaaaaaataacgcaaacttcattggctcttgctataggttgttcacaaaatgtaattagtaaaatcgaattagaatactctgttcctgatgcagacattctatgcaaaattgctgactattttcatacttctgttgattatttactgtatagaactgatcagagatatagcttggcccctgagtcatcttcattcaattcacgaataactgaatatatgttcaaacttcaatcccttactcccaaggaaatagagtccatttttattataattgacggattgctggataatgaaataaagaggtgatattttgttacgaatcgcaatttgcgatgatgatctgcctattaaaagcgagatcgagtcgctgcttttagatattatgcaagattattgcattaagatggatatcgacatatttttcgatggcaaaaccttatatcagcaaattcaatctggaacaaattttgatatcatttatatggatattgaaatgaatgatgtagatggtattcaagcagcccgtctaattcgtgctcaaaacataccatctatcttaatatatatttcggcctatgagacttatttcaaacaacttttcgaagtagaaccgtttcattttatttctaaaccaattaatgtacaccttttttacaaatatttcatggaagcttacaaaaaactaacctctcaattacagttttttacattcagttttcatcaaagatatactaaagtccccatttcagaaattatgtattttgaaagtcgtggacgtaccatcttgattcatacaactacaatgaagtaccgatttctaagtaaactcgatattattgaaaattatatgctagataatgaaatacattttttacggattcatcagtcttatttgattaatccatatcacattcgttctattaccctttcaaacatcgaaatggtcgatcatagtattcttagtatagggcctaaatatcaagctcaagtgcgattacaatacttatacatagttgaggagttataaatgtttattttggtaatttacatatttcatttttggttattacacgctttttttaactgttttttcgtttctaagaagcatcagtccttttctctcaagataatagcatgggcttgcttttttattgtacagctttttatttctagccagataacgtatcctttaatcctattcacttttaattgctttgttacaatatgtctgtgccgcttactctatctagcacccttaaaaaagctactcttcctgtccatcacattttgtgctaccggaatgctcattgaagtaatcgtatctctggttatgcaaattataggcgacaacataaatagcggttccattttaggtgccgttctttcaaaacttgttttgcttgcttttgttcatagcatatctatcatacaaactcagaatagccgccgaagccctgcattatcatcctggatattattattatttatgacaatttctagtatagtcataattcatactttatacctttttaatcaaacaagttcttttcttgtttttcaggtgttatcctttttgagtattatcttacttttattcattaatgttggctttttcctttttgatgataaattaagcaaatatacagacatgaaagtggaaaactctattttatctcaacagcttaaacattacgaggcattgcgcgctgccaaagaagagcagattaattttttcaatcgcgaaaaacataacctcaaaaatcaacttctctcaattcgagcctttgccttaaaagctgactcctcagcaattataaatttcattaattcattacttaaagaccccgactttggtcttactccattttcagtatgcgaaaatcttatatttgacgcgattataagctccaaagtcaatgtagctaaaaacaataaaatcaaatatacatgggatatagatgtcccgcactgccttccatttaatgatactgatttatgcgttcttctcggaaatgctattgaaaattcccttgaggcttgtttaaatgctaaaagtaccaacaaattcgttcatattgcagctcactataaacaaaactgtttgtatatgcatattgaaaacacttatactcatcaactagtgaaatcaggcagaaaatttttttcaactaaaagaacgtctcggttacatggctatggtttaccatcaatacagcatgttgttaataaatatgatggtgtgttacttacagaaaccaaaaataatttgtttgaattaaaaattattttatatccaacttaatcatttatccaaaaaagaatatattaactcaattatttctataacaatttctttttttggttcttcaaatagattaagtatcctctgtgcctcatcgtctatcttacctcgatatttaccaaatagtatgtaatcagaattggtgtctaacgcttcagcaagcctatacagagtatcggccgaaaatcctttttgtccattctcgacttcatacagaaatttaggagatatatcggctaattctgccaaatgttccctcgtataatgtttctcttcgcgtaaaaatcgtattttggaacctgcttcataatatatctttttcatttgtatcacttccatagataaatggtacttcatttttttctaattaaaaatgaactattgttaatatttatactgccatcgtacctattctatacatttttagatgtatttttttaatatgtcataaaaaacagggtatctgataaattctcaactctcaagtcttatgcatctataataagatattataaattatcatcaaataatccgcattgagtattccgggcggttttggttcttccgcatattttggtataaagtatggattttgagcctcatacatgataaaattaatataattaaaatgaaagaaggaatcttgaaatgcccacaaattcttcacttgatttacaacgattttatccagatgagcttgatatggtttcaattgaagaagatcctgatgaaataagactacatatgctctccagatcaaaatctttttgctgtccaaaatgtggtgaagaactgcgtaagctgcatgctacccatcaccgaacagttcaggatctgccgattctcgggaagcgtgtttttttggatataagagtacatgattttcagtgccaaaatcccatctgtgaaatcggtgcattttccgaaacatttcatggtttcttaaaccattatagccgaatgacagagcggcttatagatttcgttacaatacttgctctcgaaaccagttgtgaagcaagtgctcgtattatgcaggctatgcatgttaagattagtggtgacacagtaatccgtatgcttttgaaaagataccagacgcaatcccatataccttgtggaagccatattggtgtagatgatttcgcttttaaaaaacgacatacttatgggacgattattgttgatgaaaattcccatattcctgttgctgttctggaaggacgggatggatctgccctaaaagcatggctgactcagaataagcaggtaacaacagtgactcgtgactgcgcatctgcgtatgcaaaggcagtggaagaaatccttccggattgtatgcagattgcagaccggttccacttgcatcaaaatctcctggaggcagtaaagagtgtaataaattcaacagtgccagtggacataaaaattcctaaagatgctgctttaccttatgcagaaacagcggtttcggacactctcgtggagagcagtaaaaaaaatgtctgaggctgtggataattcaatagaatacaatcctaaaagtgtacaactatataataacattcgagaatacgccgctgccggatacagcaaaagagaaatcgctaaaattttgcattgtggacgtaatacagtcactaagtatcttaatggcgactatgaatccctatgcaaaagagattatcggagcggcatggatcaattttatgatgatattataaaagagctaaatgcaggtgtgagcagaaaagatgtctattgtcatctgctcaaaaaaggttatatgggtaagcattcggctgcctatgattatatgaataaaatcataaaacgagagcatattgatatagctgtttataaaagttcttctgcagaggttattcaaaagcgaaagaaactgcaacaatatgaccatatttcacgagcaggcatttttcgtttcctgtggatgaactctgacttgagcaaggcacattgtacttatattatggagcattatcctaaaatccgtcagttagatatatgtatccgtgaattccggaatatctacaatcaaaaaatatggtgctgctttatttattcattgaaaagtataaactatcagaaatacaggaattatcccgctttgcagaggggcttgaaaaagatattgaagcagtcgaaaattcggttgcaagcccgctgtctaatggatttgttgaaggaacaaataataaattaaaaatggtaaagcgtacaatgtatgaccgatgcagccgtcagttattagaagcaaaacttatgtatcgccctaatgtataaataccaaaatatgcggaagagccccgaagtcacggaatactcaattgacaggaatcgggatcagactacgatctttgggtgccgttcttcaaaagctccgctgggattcagggataatccatcgcacagccagtgaatctctttgagagtcactttccgcagttcatccggtgtatccggccaatggaaggaattccgatccagacgtttcatcaggatccagaatccggatccgtcccactggagaatcttgatcaatgtgcgtctgcgattgcagaacacgaacatacagcgggagtacggatcgagatggaatttcagtttgataattgcggccaaaccggtatagcttttacggagatcggtcactccgcacgccagatagacggttgtgtttccagagaaatcaagcatagttcttcaacgactgccaaagcgtagtcagtagcctggctgggcagtcagcgccaatttcaatccggatattttccggaagaaggatcgtaacagaataatttcctgtcccggagttcaactgcagctcttgttccgaaggcagctttgcgaacaccagatcaggttcaggttcttttcccggtgcttctgacggaatctttcggatccaatagcccaaagtagactgggggatcttattctgctgacaccagtcttttcgggataacccgctttcctggaaagcatggatccgatctgtccaaagattagcttttgagattacattattattcatatccattggtattacctccatcatttgagaccatcttatcaaatgcaggaaaggatttgaagatacggatgattacctacttaccttcaaacttagattttctcacaaaaatactcccttctagataacaagtttttttatacttgtctatctagaagcaagcatatcaaattgattttattatataaaaccttccgttacatatttattgaaaatcagtacacggtaaatcataagtacccgcgtattttttgaccgccgttcccggcggccggtttacacatttgttgtttttgttttgctccggcagatttccggcagctgttcagaccatggaagcaggtcttccataaaacggtaatccgtatcttcctgatggtccttcatcacagtcaggacgtattccagatagcggaaaggattcaggttattcgctttcgctgtttctgtgatgctgtagacgatcgcactggatttcgcgccgtcgatactgtcgatcagcttccatgcatgtttgtgcaggcagaagctgcgcagcgcgctttccgttgcgttattatcaagcgggacttcaccgtcaccaaggaatacttttcatgcctcttcctggttgatgcagtagttgatcccttccagggttttacctttgatcagacggccggattccttgatctcttttgcccacgcaaagaaagcctctaccagaggtttgaggttgatctgccgctgtttcctgcggtcgtccggtttcagatctgcaagctggttgtccagatgatagatcgcttcataggcgaccgtttctttggctgcctcatgctcctttttcggcagtgctttcagggcatctgcgaaataccttctcgcacgggtccagcaccctgcaaagacgatggcttcggtttcccggtccagcttccggtaggtggagtatccgtcgcagataacgacaccggtaaatcctttcaggaattcccggggatagtctactttccgggtcttctggtattcatacaggatgattggggtatccccatatccctttcctgtccggtagacccacatgtaactcttactgttcgccggccgcccatcctttgataccttgaccggagtctcatcggcctgcagcacatggaagcggtacatcctgttatgaaggtaatcataaaggggccccagataccggtcgcacactggatcacccagttggccatcacctgccgggagatgtgaatgtcattgcgcaggaattcctggctgatccggtataagggaaggccgtttacatacttggcattcaggatgcttgcagccagggaaggggtcaggatgctgtttcggagcagctcctttagccggtctgctttcacgatcgtctggttgtcctttccggcatacacagccacatggtgttcttcaactgtgtagactgccggctgtacacagactcttttatagacttcatccggaagctgtttccagccagcagcgccaaagatctcctgcagcttttcttccggaagggtatggggaatgacttctacgggaagatccttaatatcttcctcgcgttttccttttttcttccggcgcatgacctggatcacatcctcttctgcgggctcgacgacataaagcgtctcggtcagtgcttccgcttcgttaaagatgagctccagttccagttgcccggcaatcacatccagcttttcggaagagcgcccataacggtggttgtttgcagacgcgatctgctcgatcaggcgttccatgtttgtattcagttgggccagctggtcctgcatggacaggatcactgcaacgagtgtttccctgctgaaactgttcagttcttccggtaagtagatcttcgtcatgttcggtgctcctcgtttttgtcttgctgggactattgtaccgcaaactaaaagaaaaagcgaaccgagcgaaaaatgagtccgtcattcttaccaaaggataaacactctgaaaagccgaaaaaactattagttttttcagtttttcagagtactgatccacacatcagccgatcgctgtggagtactcttaatggaatgaatggtatgagatccggatgtggataactctccacgtatctgtgttggcgaaccggaaaagatttttaaatttctccgttttgcacaacgcatcacaggagatcgccgggctgcacttcctggatcggatgtctggatacgatctccagcccctgcatcagcgccctgtattgttccggcgtgatctccagagcctcttcttttgtacggggccagctgaagccgccaagctccagccttttataaaggagaaggaatccgtccccttcccatacaagccctttaatgcggtcactgcgtcttccgcagaacaggaaaaggatatccttttcgtatggatccagctggaagttgaatttcacaatggatgccagcccgtcaatgccgcgccgcagatctgtatagccggcagcaatgtaaaccttccggaatccggatgcgttattcagcatcgaggatccctcctatccgggagagcagttctgccgaggctgaattcgagatctccaggacaagtttccctttccggatcacaagatccggatggaaaacggatgatgcatctggcgacacagcaggaaatttaatctcagcgaaagataccaactgcttaacggcagataactgtcctgtctctgtaactgcaggcagggacggattctgagaggcttcataagcttcccggcgcaggatgcgctgccagtaaaagaactgtttctcggagattccgtttgcccggcaccaggcggtctttgacattccactgttcatacattcattcaggatcctggcccagtgctctgcacggatctgatgcgtgattttatccatggcgctaactcctttaaaaaacttgtagttttctggagttattatctcatggagcgaggaaactagcacggtactggggatttaccgtatacgaaaatcaaaagataacattaagatgtatggggtttatggcattccgaagaaattcaaattagcctcttgtccaaagtggttattctctccatccttttcactatttccttaatgaaaaaattattgattatgaactatatcttttataattgcttctatgcttctatctgatataacaacatctttaattgataatttttttctaagtaaccaaagtaattctaccggatcgtagctctccgtatcatattcaatctgaatatgatctgcctctactcccacaattttaaaattcgtctcttctaaaatcgcacaattaacctcattatttccttcacattttattgaaatagtcttatacctattaaactcttctctaacattctctattggcgaatctaatataatctttccatgattaattaaaataattcttttacacaaagtttctatatcttgataatcatgcgaagtaataacaaaagttaccttttttatgtcatttaacctttttataaatgctctgatactatctttagattcagtatccagaccaattgtaggttcatccaaataaacaatcgatggatcatgtaaaaaagcagcagtgatgttacttctaactctttgccctaaagataattgtctttccggcacatttaataactctttcaaattcaggacatttacaaattcttcaagattattattaaactgaacgtcaggtatattatataatttctttagcattaaaaaagaatctttaactggtacatcccaccacaattgggatttattcccaaagactacacctatatttttattattttccaatctatgctctaaaggggcaattccatttacataaactgctccactagttggctgcaaaattcctgacaacatttttattgtcgtagattttccgcttccatttgggccgacatatccgacagcttcacctttttcgatcgtaaaactaatatcattcactgctttaaattcttcgtactgtcgctcaaacatacctttcaaaaaattatcatgcctttttcttctcttatatattttttttaagttctttacttcaattatattttccatatattcttgcatggtgtttatagaagttcaaacaccattatttcctttctttttgatctggtatcatggtttaggtactacagccttaaatttgtgtcctacaaccctaattactctatagaagcgtgtaacccctacaatcatctaaattagttatatattgtattaccagaaacatttatacaaaaacttgtttcactcgaatttgcattgataatcataactagatcttacagtatcaaactttttggaaaaaggtactacatttataacttaactttagcgctctcaaataatactgataatatgcatatgctgctcttcagacttacttccctcgaatctgacacacgatcattagtcataaatctgaaggcattatattaacaaacttcttgctaatttatactcggatttccacacctagcctaattcccttagtttccagtactattataactcctcaatccttttttccaaacatttatagcaataaatccaatgataatagaagtacaaaaaactattagcggtataggcaatgtttctttttggcaaatatacattgatggataatatgcaacaaaagcaaaaggcagaatagccgtaagcaatacctgcactccaaatgaaaaaacattcaaaggatatcttgctaattcacgtactgtttgaacaaagattgctatagactcacctcgaaccaaccaaaaattcaaacaattaaaaattaaatatatacttgaattaattataaatccacatattatcatttcaatagtacatatagctagttgccaattccatacaacgccaacatgatttgcgaaaaaaagaaacataaaaaaactcaatccaaaactaacaacggctggcaattgaatcctaattcctaaaacttgaatcaggaccgaagtgggacgcagaatcatataatctatactaccgcttcttacaaattcgcctatctcccacacagcatccccaaacgcttgactcaacgcttctgtcattcctccaaaagcaaacaacagacataattcccaaattgtccatccacctaactttcccatagtattcgcaataataatgagtcctaaaaattttacaaactctctcaaaatcattgacacaatccaaataatactatctcccggatattcagtcataatattccaggccatctttaaatatgaaatgaacacttctaaataatattttgctctaattattttcataaatctatccaccctgaacagtcacttttaatattactcttttatagattgctttacttataatggacaaaataaagatccacataatctgcaaaatcaaatagcctaaaatctgattaaaagtatattttcccaaaatacaattaaccggaacagaaatcatacttgcaaatggaagataaattagtacattttgaattatttctgggaaaaaggcaagcggtataatacctccagccagaaaacttaagattgcatctttcgaaaacttcaagccataactattcatggtatagaatccacataaacctatcaaaaaatcaaaatagaaggtaatacacatggccagaaacaacataacaacaaaaataatgaccaaccaaaagttagtttttatttccccatttaacatcaccatcgaaattataaaaacaggtagacccttggcaagataaaaaaaagcaaattcacccattctttttccaaataaattttcaattaacgaaattggacgcatcaattccacatctatttttccttgatatatccacgagctcagttccatgtttattccatttgacatgtgattatttaaaatttgtgacaaaataacgtatacaacaatttccttcggagaaaagccattaatttcagagctatttttaaaaaccgcttgccataagctaaagtataaacatattgctaccaacattcctagcagatcaaaccatacactttgcatgtatgccattttttccttaaaactcattttcccgaaatacaacagggttgtaatctttttcataaactccattatcgtaattcctttgttattattatttcacatggttatatcaaagagtactggtaccgcagcattttaagcataaagcatttctattcattacacaatatcctattctataattttatcagttataaaattctaaacttagcctattatctttgtaacgatctaattttctttctgactagtatcatgtagatcctttttataatgtaaaaacgcaaaatacagcagaatcactctatacagtaaccgttacatgtcctttcttatctttgccttacttttcccaaatcaaaaaaagcactataactgtctatgcatctccctttcctataaatatccgttcttgtaagaatctagtaactttagaaatctacaagtttttagtagtaccccttatgcataaaattaaatacctcagatatctacagaacgcaaaaaaaatcccgaatgaatacataaatagtagtagaatactcaaaattacccgttctaagaaaagggatttcataaaacctgttcttctcttggcgtaaaattttttgtaaaaatttttatggaatctcagaatcccttactatgtgtgctattttgtttagattagtctcctacaatttaaaatgtgatattttctctataattaaacctctatccgtttctcaaaactcatctactgttttatccgtatcctataatcccaaaaggttctctctcgtgtcaaaagaattctaggaatcaaaataacacaaccggactccagatacaaattgtctgcattaacagatagcctgttctagcagatcgcaattcccctcttatctataagctatctcggataatagaaaataatcacgatacggcaataccagttattaatgatgaaaccagagaggatactctgacatctaatccgggaagtgtatttctgaaatctcctatagatcattattcaaaatagaaagaataaaaactttttccgtttttgttactatgaagagatataggaattatccacgcccaagtcttattgttttcatctgacaaagatttctcactggaatcatgctatagtgtagagaaagctctggtaatctttttaagtaaaatcaataagattccgtttaccacgctgaattctcttgttttatttgctatattctatacatgttcaactttttctcttctgcattaacaaataagtgttcctttaattttcatgcactaagcagctcaacattaaaacaaacatatcaaaacaactgaaatccatttcttaccaattattttctatagatcgtttcaagaatatctgctatttttttacttgcatatccatcgccatatggatttattccattgcacatttcatcatattctttttcattatctaatagttttttcatattattgtatatgactttttcatccgttcctacaagctttaaatttcctgacactactccctctaaacgttcagttatgtttcttgtcacaagaaccggcttttttaatgctgctgcctcttcttggatacctcccgaatctgttaaaataaaataacttcttttcattatattatgaaaatccataatttctaaaggcgccaccaaatggatttgtgaatttctccctaaaatttcatctgcaatttttcttatttcaggattcagatgaatcgggaagagaattctaacatctttatattcatctacaatttgtcttattgctctaaatattttcctcataggttcacccaaattttctcttctatgggtagtaaccaaaattagtcgatttcccttagcccactctaattcattactatgataattcttggatattgtcgtcgccaacgcgtcaattccagtatttcctgttatgaaaatattgtcatatttctttccttcgtttaacaaattctgtttagcctgttcagttggtgcaaaattgtattgagctaaaatactcactatctgcctgttagcttcttctgggaatggctctgaaatattatatgtccttaatcccgcctctatatgtgcaataggaatttgtaaataaaagctggcaagagcagctgctactgttgttgttgtgtctccatgtatcattaccaaatctggtttttctttttctaatacctgcttaatattagataaaatagaagaagttatataaaacagatcttgtccatttttcataatatccaaatcatagtctggaataatattaaaaattcttaatacttgatacaacatttctctgtgttgacctgtaacgcatactcttacatcaaaagttccccttgattttaattcattaattagcgggcacatttttattgcttctggtcttgttccaaaaactgcaattatttttaacataattctcgtccccctgattcattgtattatatcccttgtatatgttttttctaatacatcagacaaatcttctgttattctattagctattattaaatcgctttcttctttaaatttttgtatttgtttttcaactttaatatcttcataatattctttattccatttaggttcaaaaataattgtttgacatttatacgtttttaaccaatgaacaatgtctaaaactgctgattctctaaaattatcggaccctcttttcattgttaatctgtaaactccaacaattactttccgttgctttttagaaattttctcaatttgtttctgaatttcatttataataaatttttttctgatttcatttgcctcgatgcttgctgaaatcagtctttctggaatattagtaaaactttttcttaattctttagtatctttgggaagacaatatccaccatatccaaaggatgggatattgtaataatttccaattctcgaatcatcacaaattcccctaataattttttcgctgtttaatttcaaagaaaccgaaaaattatcaatttcattaaaaaatgctattcgcattgccaaatatgtatttgcgaataatttaacagcctctgcctctgttgtattcataattctaacaggtacatttttatgatcttccaaaaaaatttttgatatatccattatttcccttctatttgcattttcggagaaccctatgataagtctttctggatttttctcatctagtaacgaactcccctccctagaaaattccggaacataaaacaaactaatagaggggaactccccttgcaatactttgcatccttcaattggcaaagtagatttaataattaccacggggattttagaacatctgctaatatcttttagaacttgtcttattgtatctaaacccaagtgccctgtttgatgattaagatttgtaggtgttgcaataattacgtaatctgcatcttctaatttttcttctatgtcactacaaatgccaagctgcttttgtgatcttgttttttccatttcaaaaaatttttgtatttctgtatcttcaataggcgattcagcatttaagagctttgctattttttcttgatctatgtcaaaaatacaaacattatttttttcgctcagaaacacagcaacagaaagacctacataccctgcaccaaaaacaacaatatttcttttctttctatttatcatattatatttccacctctggcaattttataaaacttgcttttatatctccacagtatattttattcatagcctgtctatttatcatttcttcttgaacatttattctaggaaaattacttgaagaaatttcacatctaacccggtgcccagccaaaaaggaatatgctattgttcctatagtcaactcataacttccttttttattggcattttgttttattctcagaacagagtctaatatattaataggacaattatcttgatcaacatctactatttttatagcatagtccatttgttctaatgttgattcacaaactaattgtattttaattttcccaataacacataactccttagttaacctttcagatgtataaaccaacacatcttctctattttcaatgagttcctgatttttggggcctcccaatcccttagggattgcatcaatgcatcttcctccacaagttggcacaagatcatttcccttatacgtaaactcgtcttcattgtttttactttcttcccactgtaatcttctttccttgtctcctaatgaattagtatatattgccaaaaacatgtttctttcgattacagttggctgtttatgcaaagaataccatttattttttcccataataaatagctttatttctgacacaacatcttcacctttttctatcttggaaaaccaatccaaaatgtcagttgatgagtatttttcaaaattgtatatgccgtagtcaacatcgcctacagtggctttaaagatttctgtatgcgaccacggtccgattactaatttttgaggttttgaagatctatttactgctaaaagaaattccttaattgttccttcacaaaaaatatcataccatcctgatacatagtacccacttgcatcccaataccgagcatttgtctttttgtctatatagttccaatacttatcatcattttcattgatccagtgtttatagtatgggagattattatttactggaaaatctgtcaactttcttttatataattttgctatatcatttgatagaaattgtatgtaatcaattacagatggttgtaacatatgttcctcgtcagtaaaagcaaaagaatgtgaccacgactgtacaaatgcttgtttaaggcaatgattttcataaaaccaatctcttcgtatatttcctgatgacataatcggtgaaattgcaactacgccttcctctccccccatcatcatcgcagtaaatccttcataagaaacacccaatgaataaatatgcccattgctccaattttgttcctttacccattcaacagtagtttttccatcttccttttcattttcaaatggcaaaaaaatacctgttgattcataacgtcctcgaacattttgaacaagaagtgcaaagcccttttttacaattatatatggatcaaaaacagtatttatattatgctttccatacggtgtacgcataataattactggcactttatccgattgaacaggtagatacaaattaccatttaaatattctccatcgctggtttttatatctacttcttgtaatataattttcaaatttgattctcctcatattatatagtagtagtgtttatagaccctctccaaggtctgtatgctatactgtttgtagatactatggatcggtacattgctcctaccactctgatttaaggactgttccaaccataatcttttttgtagtttaaaccaaccatataccacatagcagttaattaagaacgatgttgtaatctcaaggagtttcttggattctacaggacaatacagaaaagaagcctataccttttgccatgaaactgtaaaaacatccaccaactctttatgtcctcaaagtctttggaactaaaccacaccctcaaactctttcatcaagtaactccttaaattgataaagtcatagcagccatcaaacgaatcatgagaaaaaatttcattcgtctattctaacaattcccagcatcaggtcagtggatgctatgactattgccaagattaataatttcaaccgttttgattctacaaatactatactagtattcttcatccatttaccaatccaagcatatgtataatgctataacacatataaaacaaaattatcgatatcttcatatgctctttacaacactacaacatatatctatcatcgtgataaatcttttggtgcatatttgataagaagtaagacaatcaaaacattacaccgtttctttatctcatagtcctaaaataatataactattttttgccatgaacaaaaacactcatacctaccaacagccggataaattctacatatatcctcttttagagtgccagaaatgacactctgtttatcatgcggctccaaagttcatatatatctgaagtatattttcgcaattcattcaatatttttcattttagattcgacatttattataacaagtagtctttctttaatttttcagtacaaatctattttttaagtatctgatttctcatttcttcgtacacttttataaccatatctgcgccaaattcttggactaatgttgtaacctcctttaaatatggattaataacctctgcaaaaggtggacaaatatttgtaacatccgattttgttgtaataattccatcccatctttcttgcttgttatataatgcatcacacaaagaattttgtcgtaaatcaccaaaatttggacattctttagatgtctgataatcacaaggatatacttttccgtccgaaccaatcgttgcaaaaaaataacgataatagcatccttgtgaacatttccaccttccacgacttttttcaggtacataagtgtgcatcattagtaccttaaaccgttcggaattatatttttttatataattatttattgtactaatcatagcttcttcattttcgattttatctttctcatttcccgttatatcaaatttgatacaaatagaatttgccccaacttctattaaatctttaattaccgtttctaaatccttgaaattgtcatatgtaactgtatagcctgcattaatttcagtcttactttctattctttttttctcttctaccaaacctttaatattattaataatcgtaaaataagtatacttaatatagtttggctgttttatggcattccaggtttcaggtccaccatctatgcttatatgaacagaatctgtatggcatagtacattccaagtcttttcagtcataagagttccattcgtaaaaattcctatcttaagatttcctttttttagtaattttattgccatcatcaaacaatcccattttagtaatggttctcctgtgaatcctgaaaattggactgtttcaattttcgtcccgttttttttagcacatatgatttgagtagcaatcctttgtatatcctctttattcattgaatccggtatttcggatgtttcattttctttattaatattagctcctacacaccatctacaattcaaattacatctactggtcaattgccagtctatttgaattggcaaaatttcattttgttttataaattctttgaaccatgtatatttatcaattattaggaaacgttcaaatcccaaaatgtcttctgtaattagatctgtcttttccaataatctatttaacaattttttgtatacctgagtatatgaatccatcattcttccgtccatcctgacattctctttattatctcataattctctatcgtgctattcgcaaattttagagctggagcttccattctgttcattacacctttacaaaatctacaattattaagaagcctccaaagtattgtttttaacatgaatttttttgaaagttttgaatttttcagcaaaatcattatatgatctttaatataattttttgtgctaatcgtattcgttattgtttcaccactttgttcttttattataaattcattttccgtaaaaataatttgattatcattacaatttttaaataatttaagtgaaaaatcaaagtcttctccataaccgatatttgtacaaaaaaaagagttttcttccttttcaatagtttttagcaaatttaatgcaattaaggttgcatgatgtgggaacccataagctgcacatttgcatagtttgctaactgttgcatatttctcttgcaaataatatttacttgctatctttttagacgaattagaaaaaataattgaaccgcaaattaataatgtatcttgttttttcatatttatagctttgcttaatacatgcggattgtacaatatatcgtctgcatcaagcctcatcacccaaatatctaaatcatttctcatctgattcataatttcttgtattccacgattcataggtttagatgcagaccgtttttcgtttttacttcttccgatcggaataatttttacccttttatcatttccaaatttatgcgtaaccaactccaacgctccatcatctgatccatgatcaacaacaaatacttttacagaaatattcttttgccctaaaacactacgtactgacttttcaatgctagatattgaattgtacatcgggataaccacatttacttccattttcatctttttattccttttttatccaaaatttgccatttaagcacaaataatcaataggaacttctaaaaatgtctttattgcattttctggagtttctacaataggttcgttgcaattaaatgaagtatttagtaaagcttttcccccagtattctctttcatatattcaatgatttctccaatcccagaattaccggcaactgtctgtattctagctgttccatctaaatgaaccgctgctggattttcatctcgaaattcatccgtagtttctacaatgtgcatcataaaaggactatactctatatcccttgtacaataatgcacatctttttccaatactaccggtgcaatcggacgaaatggttctctaaatttaatctcgttattaagtctttcttttatcttcggatatctcggatcagccaggagacttctatgtcccaacgctcttggtccatgttcactcttgccttcataccaagcaattacttttccattactaatttcctctgcagttcgttgaataatactaaatcgatttaaaggttctgccttcaccccatatttctggatagctcctatacattcctcatcattatattctgtaccgttaaataccaagtcctgatcacttattttacaagtttttaagtttagtacattattcaaaataaacataacagcccccagagaaagacctccatcatgtactgaaggtggaacaaagactcgatcaaatatctttaatttggcaagttccgtatttaaataaccgtttagtgccactcctccacccaaacacaacgttttagcttttgtcacctcatacgctttttttgctaaatttattccggcatagtttgtaaccttttgtatagcatatgcaatatctgcagcatctttatgctgccaactatttacagcagaaaacattggcatatcctcatccggccaacagtttttgatagcttttgctggatttagacatcctcttacaggtctcatacaataatccgcaaatgtttctacaaatttgttttctcctaatgcagccaatcccataagcttaccagcagcgaatggattctgaaaaatacttttagaataaatatgccaaagcgagccaatatcacaatttcctatttttttaaaccacttaagtttattgttctcccaataagaaatacttgtagaggtatacgcattcgttgtataaaaatctccacctccatcccatgttaaagtcactgactcttcctcattacttgtataaaacgcatatgatgcgtgactcaaatgatgcggcactgaaaagcatggtatctctcttccgtaaaatttaactttcatttcaacccattcatttggttcatcatatacctttttgctaacatattctaatcctggatccgttcccttaaaattggcttctgttgtcataataacatcaatttcattagggctaattcctaactttcttaatgttttctcaacataatccataacatttcctgaatcatgtctaatccttgaaaatctttctttttcaaatgcccctaataattttccatccttaaagacacaccaattggcgtcatgtcctccacaaattcctaaagaaatcatttttatctcctagcctaatttttatcgataatgatattattaatctcttgacttcgtgctttccatgtgttctcttccgtaaaattacgcatcattttatattcattttcagtaattttatgatcaatcattttttcaactttatttgcaaactcttctttactacatgcaaattctatcattggataatttttaatttctggtaaatttgttgaaacaactggcagaaacgctcccaaatactcaaaacattttaatggtgaacacgctttggtaacttcattaaccacaaacggaactattgctaaattcgcttgtcgtaagtatgatactaattcttcgtgtggaacttgtcccaaaaatttaatattataattatgttctaagtttttaataatttcagcaatatttctcccatcatcttcatctttgcatggcaaatatgggcctaacatcaaaaattcgtattccggaaatttttcaacaagatattctataatatccatttcaaaccactctggccaaatagctccagaataaataatttgttttttctttcttttactacgtccttttacttcttcataactcataaataatttatcagcaaatgcattttttattgcatttggaataactttaaattctttatctgtaatctctcgattcttttgagctagccattcactaatagtaatgcattgatctgccatagagatatattccttttccacatctttcccccaaggttgtacaggaaatccatcccaaaaatccatctgatcataaatgtgaaaaattcctttttcttttgccttttttaagattccaagaaaactttctaccggattatgggatttaatataatctggtctccatttttctaaaatgtcatcttctgtttcaaaaatttcggcctgttgatgcatagctataagttttcctgattctttgtctctccgtaaaagtcgtaatctgtgagaattaaacagtgaaaattttttcatttgatctatttctgaatcactttcaaataaaaaaacaacttcatcaccacgcgcaatatcctcttcacataagcaaatcggcctatgaccgcccccactaatccatggattataatatgctaaaatcaaaattttcatctttctcctcctaattttttcttaatggtattactttaaaaaacttttatatcattttatctttccatgtcttgggagttttatcattaattatttcaatatcataattgtactcaaactcctctgctccatctttctttatgtaatcaaccatccttttaatacttgtttttaaatctactttagttttataatttaatatccttcttgccttttctgctgaacaggtggcatatttgacctcgtttgggcgtgctggaacataaattgggtgcagattaaattttaattcatttgcaattattttagccaattcgtttatcgacacaaattcctcatcaggtccaatattaaaaatctctccattcaagtcatttctaaaaattagttgctcaatacaataaattacatcttcaatatcagaaaaacaccttttttgttccccatctccataaattatcggttgtttcccttgtaacattctattaatcattattgcagctacatttctgaacgggtcatttgaacgctgccttggtccgactatattatgaggcacaacaatattaaaatatatgtcatttagttcacatatttgtcgaattaccagttccgcagcatattttgccactccgtatggtaccctaggattacaatccatttcttctataaatggcagtgtttcctgctccccatatctagacatgctagaacaatatataaatttttttattttattctgtgccgcagcactcaagacactcatagtaatcccaaatgtattatgagtaatataatacggtgaaaacaatgacagtccatcatgagctgtacatgctgcatgaaaaaccacatcgcaccctttcatatactcattcatcttttttaaattaccacaatcttcctgatgaaattccacttttgaatttacatttttcaattgcccgcctactaaattatcaactccaaccacttctacaccttgattaataagactatctgctaaatggcttcccaaaaagcccgcaacacctgaaataaatactttcattttgcatctcctcctatattccatttcttttatttttatgttatgataaaatgggtatttttatatttcattctttttataaaagaaatactcacactttctatataataaccatttatctaaaataaggattaaaatctattctgtaatttttatttagttgcctatctttaatttttttagaaggatttccataatatatgcaattactctcggctttccccttaaaaatactccccgatccaattatagctttttcttcgattatagaattatctagaataatcgcctccgttgctatccatacattattttttatccatatgggattggttttatactcaaatatttccgatcttgtactatgtgtacacgaaattatttttgcaaagcaggagatagatacatcattttcaataatgacttttccacttccatccacaaaacatgaatggtttataatacttctttcccctaattctattttttgtggtgcaattattatggtatataaacctattctcgcccccttccctattttcattccaaatccttcataaaacttttttctaattctccaacaaggaattctattaactaaacaattcaatattataaaggtcatatccttttttagaaaatcccaatcaatatttttcattttatcatatcaccacatttcactttccttgcttttttaaacaattctttattcttttttgtaattctaatttttttattttcattttttccacaaatctccaaatcaattctacctttcgcaatctgtggatgtcttaatattctcactccttcgttgtctactttttctttcgcaaaaacaatatatgaatatttttcatcttcataaggaacatcggcattttttatcaatttgtgcaatttacttctttgcactctacatgtgaaatgacaccaatcgtcactttttatcctacattcttgttcatgcggacatggtgccactatatgtgctcctaaattaagaagttgttctctagcatattttattacatcgaatccttttggcgttcctggttcaataataactaataatttatcggcacaattccataatttactaataacagtctttctggcacttccagtcatttcatttaaaacatatgaggaaattaccatatcatatttttcttcaatttccatgttaattaaatcttgtgaataccattctgcttgttgaatagctctatggccttctctcatatattttcttccaatcttttccattgcagcttctttttctaagcatacaattttttctatattgaaataattacaagctgcccaagttgctgccccagtaccagcaccaacatctaaaaggcttttacattctttgctatatagtttttttgtttggtctaaaacactagatacagcttcatatgttgctggcatccgaacagcggaatagacaagcgcttctatttctttattaataagtgacctatttttcccactctcgttcctatacttatttgtaatattatcagatattatttttacttgttttaagtcaagtttctccatttctttttgaataacaattgctaattcctgtggaaatgccataatatattctcctttctactacaatataaattggttaatatacttaacaaccagttaggttgttagccatcttattgcttaagctgtataatgatggggcaatcggtatatcggcttcctttcttggacttacacgtccgtttttaagactgataaccagctcctcattcgcagcgttcgttttatgcaggttgaaccactttcagtgcgttcgtgtcacaccacagtagattgaataggcaatgagtaaagttggtatttatcttttgcactataaatcttaaggagtgacaaatttatgaacatgaacgcagttggtattgatgtttctaaaggtaaaagtatggttgccatccttcgtccttttggtgaaattgtttccacaccatttgaagttaagcatacagtcagcggtattcgctctctcatcgggcatatcaaagccattgatggtgagtcacgcattgtaatggaacatacggggcgttattacgaaccccttgtccgtgaactctcacaggctgacctttttgtatctgccgtaaatcccaaacttatcaaagactttggagataattccctccgcaaagtgaagtctgacaaagcagatgctgtaaaaattgctcgctatactcttgacagttggacagaactcagacagtatagtctcatggacgaaattcgtaatcagcttaaaaccatgaaccgccagtttgatttttacatgaaacacaaaaccgccatgaagaacaaccttatcggcgttcttgaccagacttatcccggtgcaaatacctattttgacagtcccgcccgtgaggacggaagccagaagtgggttgattttgcaaccacctattggcatgtggattgtgttcgcaaactgtctcttaacgcatttatcaaccactatcaaaagtggtgcaaacgtagaaagtacaacttcagccagtcaaaagctgttgaaatctatgaagcatctaaggagatcgtttctgtacttccaaaagacgatttgacaaaactaattatcaaacaggctgtagagcaattaaatatggcttctcagaccgtggaacagcttcgtaccatgatgaatgacgctgcttccaaactgcctgaataccctgttgtaatggctatgaaaggtgtcggtaaatcacttggtccccagcttatggctgagattggtgatgtttcccgcttcactcacaaaggggctatcaccgccttcgctggtgtcgaccccggcgtaaatgaatccggttcttacgaacagaaaagtgttcctgcttccaaaagaggttctggcactcttcgtaaaaccttatttcaggtaatggatgctcttatcaaaaccaaaccgcaggatgaccccgtatatctgtttatggataagaaacgatcacaaggcaaaccttactatgtctacatgactgccggtgcgaataagtttcttcgcatctactatggacgggtaaaagaatatctttcatcgcttccgaaataaccatctcatacttacctttattttagaccagcgaatatcggtggtcttatttcaatgttcaaaatcctacataaacctttttgcctgaaataatcaatttactattgactttttatttgcaggctctaaatactaagttttcagatacattatagcatatatatattttttttatctataattcactttatataaaacctattagtatttaaatcgatttctacttctgtcccatcagaaaaaacacttttttgttttttataatcattatcaataaactcatgtttaattaattctttatagactacttttttatgcagatccattacaattttgcaacgctttattcgttctttaagacttaaattttcatcatttccgaagcatccatccatattaggatatgatgattctctttttaaatacggtattccgccattgattaatgcataaagcatataatcttcatctttatacttttccatcatccacggaataataacacactcatgataaactaaattaaacaacggaaccggtattccatttcttgcggctttttgatcatacatcataaaattgtatggtgcataatgagcaaatactactccaggtaagctccagtcagttacttcttctgagctagttaaaattccttttgaaattaaataataaaaaatctgcattctataatccaggcattcttttcgtgacattttgtgcttataattataacattcatccccttcattacagttaaacacatcaatatatgtaccatctaaatctatttgatgctcttccaagtttttgtaattcctttttacaaaaggtagtacttgagatgcacataaataggattgttttccacctgcccataattgatgcaccgtaatatttccatcagaattttgacatgcaaattcttttgaaaaagattttgcatcaaaataaaagtctcgatattgatcatgaataccgcccgcatatcctaaatcatgtagtgttttaataaaatccctaaatgcatcccatcctcccgcttctttacatgcttctaatgcatctggatgtttattatcatatccatcttgcatccatccatctaaatgaacataggctttttctaatcccagctttgaataattaataatttcctcttttctttcttcaaaagtagtaagggaataattgttctgaatattgttcttatcataaaagatagacgtattagcaatacttgtttttattccttcatgaataatagcggctccaactaatttatctacatccaacttaattcttttttcctttaaagttataaacttcccctgttcctttatatattgtttatactttttacaaatctttgtataatctgtattttcttggaaaatcattcttatacatcttttgtaacgcatcaatcctaagcttggtacccatctaacgcctatatgtgtatatggtcctcctgctggatgatcaacgtaataaaatgcatcccatggttgttcacaaatagcaagataaccttgtccatcttttatttgtgcataccatggcatataggaagctgaagtacaaaattgtccatcaaaaaatggcattccaaattcgttttcccatgtattcggtagcaatagcccttgctgtacattaattagtgtataccaattttgactttttttctcaaattcaaaatgacaaggccaacatatttcacttatcttctcatcttcttttatcggaattaactcaaatatgacatttttatcatttttttctatccatactcttgtcattaattcatagtttttttcaaaattaccaaatcccgaaaagtaagtatcaattcctatacctatagcattttcccacttattgtggttaataatatcggcctcatttaaatagtacttttgtttattttctataaagtatggattatatgatgaatcgctcttccaaaaagtttcattatatctaatctcaatttttaatgttctttcgcatattttaattttcatattttgatattcaatttccatttgatggcacttccttgattcaataatttagaataaattctgatttaataataaaagtattttttattatcgaaaaccatacattgtacctatataactgaactatagccataaaacatacaaaatcgaaattctttcttcttgaaatatcaagaaatataatatcccttgcctttgtagcaaaaaaatatgtaatatttgttgatctaccaaactccaccttatcttgctttcactcaaaaagcatatttaatgccgggtaattagttatgccaataaatatgtgatgaaacccgtaaaatcgccaagccaagcaaaaagtatcggtctaattctaagctacttcgtcctttctgatatagtgtaggtgatagcaagtcaccaaccacagaaaggagtccctatgaaatttgatgaacaagggttccgtcatctcgttgacgaaaccatcgccacaatcatacggttaggcacaacgtcccatgctgtgcttgaccgttacaaacgctttactgaaatgctggtaggacacttaaaaagtctggatcagccgtttgaactgacgctctgccttaaatgggtcaattctctggatcacgatccggcttgcgtgcttagcgcatcctatgttggctggaaagcactgcacaggttcgtccatctgccggcagaacagcaggccggaacactgacggaatggcgtcattatctgtgtttcaccccggaacttcctgaaactgatgaatataaaaacattcttgttgaatttcaggaagttatgaaagaggaaggcaaatatccgactaccataaagtcgtacagttccatggcccgcaagcttctcctttatctggaaagcgtaggtattacaaagttttccgatgcaaggaaccaaaaccttctggactatttccagacagaccggttcaagaaccggaacctgaaagggttccagacggaattgtgtgtcctgaaaaagtttctgcggtttgcgacagatgccggttacacagcctgcaagacccttccttatgccctgcctaaaatccgccagtccagaaacaagatcattactacgattgacgaaaaagtagaggcagaccttctggaagatgagccggacagccttgtcaacaagagggatcaggcgattctcctgttggcgctgcacaccagcctccgaagctgcgacatccgggcattgaggttctgcgacatcgacttggaaaaagagaccatccatatccaccagaaaaagacgggggttgaccttgaaattcccatagacagcgccacacaaaacgccattattgattacatcctgaacgagcgccgggattgtaagcaggaatatatttttgtcacgtccgtagacccgataaaaaagctggcccgcaggcattacaggatgaaataccgtacacaggggacggaatcctatgaaaatcttccgcacgatggtctccatatttaccggcgcacttttgcgtcgcggcttttgcagtcaggaacaccgttaccgctcatttccgaaatgttagggcatatcgacaaaaactctgtccgcgtgtatctctcaacggatgaagcaaaaatgaagcggtgtgcgttagacatctccctgatcccttgccgaagggaggaatactgatgtacgcaagtaaatttggccctgttatggaagaaatgcttaccatccggcaccgttccggtttgcagctaaagtttattggttttttccttaacgactttgatgctttctgcgccagagagtatccagaagccacactacttacaaaggagattgccgaaacatggattcacagctccgattctccatcccggcaccacatggcgcggcgggtcttaacaatgaagcatatcggggaataccagcagtcgcttggcttaaacgcttatgtcccgaattaccggattaagaggccaaaggcagaggaaccccatctgtttacggatgaacagctttcgttgttttttgaaactgttgacaccaagctgatcccgacagagacatatccgtataaagacacgatgttcccggtatttttccggctggtttactgttgtggcctccgcagctccgaagcgtgcaacctgaaggtgtcagatattgatttccccaaagggacgatctgtatctaccaatcgaagggcatgaaagacagggagcttcccttgtcagatgaccttctggacttatgctaccgttttgaccggtattaccagaagcagttccctgatcgtacttattttttcaagccgaaccaggaacgggaacacatgataagcgccgatgtcagcaagatttttcaggccatacttaaaaaggcagggttgttggagctgcccggaaaaaggtttacaacgcatggcctccgccatctctttgctgttcaaaacattaaaaaatgtgctgacgcaggagaagatttctataactggattcagtatctttgcaggtacatgggacacaagcacatccgctatacactgtactatctgcatatcacctcacagcttttccctgtctaccgggagaaggtggacgcccttgagaaaggaatcggtgtggtctatgcggaagaataaacaaaagccaaaaaagatgtttttcatctacacaaaggattttttcaaccacttgcgctctgaacttcacagcgaacggacaatcgaaacttactgccagtcattgaacgctttccgtatttatctctacgaaacctactcaaaaactgttgaccagatcacaactgattttattacagaagaagtgatccgcgaatttttgagcagtgttgctgacaacaacagtgttggggcacacggaatgtccggctgtccgggataaaggcacacctgaaatatgccgccacccgtgatatggagcttgtacccctgcaaatcagcatttctgctgtgaagcacaagaaaacgtacccgaaacgccataactggctggataaggcagatattgaactgctccttgcgcagccgccacagacaaagataggggtacgggatcgcttcattatcctgttcctgttctcaaccggggcgcgacttgccgaaatgcgttctgtccagttaaaagacgtcattataaatgaaaagtatccgtacatccgaatcaccggtaaaggaaacaaaccgcatatcgtccctatcccggaggattcttttctaaaaaactacaagtattactgcccctttaccatcccaaagagaacccggatgattatcttttctatccgactgcaaaaggtggcagagaaatgatgtctgaggacaacgtgcagcgcatcctgaaaaagtatggggacgctgcccgctgttccaatccaaagctgccttccatccatccgcaccttctccgacattcctatggggcgcagctatacaggcttggggtctctctcccggagatagcaaaacttcttgggcatgaggatatttccacaacggaaatctatgcggagactgatcctgaaatggcggcagaagccatttcaaagatgttgggcaaacagccggtaaggaaatgggacttccttaccgaagatgaaaagttaaaaatcttaggactaaagtagctcagaattaggccgatactttcttgctaaacatggtgtaaacaccggctttcgcagaatttatcggtcttattttttacgaggcattaaaaattttagaccgatgtcggtctaacgctttcattcccccttaattattttattaataaaaatgcttttctatgttgctccattttttttgccggatactgaaaataactttttatctgtttttctgtcagcccctgttcaatccctaaaataatctcatttaattcttcctccgacagccttgcactgtatcgcttgatacattctatcagagatccggataaatcccattgttcttccttttcttccaaatcagactgtttctgcccatttttcattgccagaacatcctctggcggcgtttgatccgcttcccgatttacatttcttataatattttgaaatgccttttcaatttcctgctcagaaggaaacggagctttattccagtcctgatagagaaattcttttccttttgcctgaaatacatggatattcgggtctttcttggcagcttccaaataatattctgcttctttccggtctaaaatgtgaatacggtcccgacacaggatcgtgtgataggacatagtttcagaatcgtaatatgtaaaaaccggatgctcgtaaccgccttgtttgtttaattccattgcatgaagatactctttcgtatggaaaggcaatgccttttcatccagaatcggtctttgcccttccataaaaataatgcacttttttcgatcaagtcgcttgacttcggccggagtcatcagttcacgcccggactgctggtaattttcactggtacttccatttcttcccatgctgcggccatcatggcgtgtatcaatcgtcatttttccaagcagttcggaaatatatttatgagtagataatgctcccggccccgatcccaagtacaataaggtcgcacaattatccagcatggtttcccatttatcatttttgaataatgtcttaatctgggaaaccgactgcagcaccggcatcatacaaatatttcgggatcttaccacccccagaaggacatccggatcggtcggttttgacccggcatagaattcatccatccagaactcaaccggaatagggagaggaccatggtattcgttatctgccatccgcattaagatatcgaatgcctgggtataaaaaatggaaatcaaaaaattgtaggatctgtcattatccggcaagaccagcaacaacgcaatcttacggtctgttggatgctctgctgttcctccaactcctgctcccaattcccgtatctggatatcatctccttcaaaaatgcgttttacccctgccgtttcgcagagttttagcattgcatttaccatgatgatgatactccgaacagtttccgttgccccttctttcagttttcggtaatcccgtaccggcgggtaaaaatccccttttcgttttgccagcttgtccatttccagctggagtcttgtagtttccccatccggcatcttttgtgtctccaaattgaccagatatagaatattgttcatacttcccacacgggattcttccatcgactccagccattcgtagtagaaaatcgcctgcaaatacagatctactccgtcatcccaaaacggttcgccctgcatggcatccagtttttttaccgcttcatggagatttgtgatcagcctgattaaatcttcttccttctcaatatagaggaatggattgtaacggtccgatttctccgggtttttgagatttaaagaccggatcgtataccctttttcctgcagataatgtccaaatttatactgcagctcccctttcacgtccagcgcaatatagtgatttgctgcctttagtaaattgggagtgacgacagcgttggttttataagatcccgacgatccaataataaacatattgttattggataacaccccctccatggatacggacacatgtttgctcaggattctatttttccgttcatctttattccgaattctttttagacttccgggtgtcgcccattcttctgatccatattccttattaaaatggaaatttcggttatgatagctgtgccagtttacaaaacaaatccagcctaataggccaattcccagacaggccgggcttttgtcattccaccagtttcttaatggatgcagaaaaatataggctgcagtatcctgcagattctctatagacaaaccggaaaagaggaacaatccggacaggaaataactcactgtcaaaaaaataagcaatgcgattacatacagtccaattgcgggtttctgcttttcaatcatgccagatcctcctgcctattttgctttgattggatttgccggaattttttccggtcttcccgttttcacagctgcttctttgcctaatgcgatcttggaagattgctgtatagagtctgccactttggtataatgctttttcaattcagctccgcttcttctggcggatattggtataattttcccgtatacattgaatactaatataactcacgtggttttctgtcggccgggataattcttcgatccctttccggcctccctgcatctcccggttaatatgctgttcaaataatgcctgaaacttctgccgatcttcactgaacacggcaatctggaccattccatccgattgattagatccggcatcacacagtaacggatttgtgcctgttttaaatcctgctggaaacggaccgtatttcccggcacattgattaaatccagtttcccttttgtaacctttatgaatttttcgaatgtaagaagatccgtgtgttttaacaacttctgatcatacattctggatagcatctgatataaccataatgccattctggcatctgcaaataacagcatacttaccatccgggtaccattctgaatgttataaagtactctttcatcttcctgatccatcgtttatcctctcctactttccaggctgtaattgcggcaaattctgaattttttgtaaggatacagtcttctctatggatgattccaaggctatttctttctgatttaaccgatccgcgtagctttgtgcggtttccttattgcgaaattccaagataacgtctctttgatccaacaccgcttccccggtcttcgtgtctacaatcagataaatctcttccggctgattctcctcttctttttccgctttcaaaaagccttcttctgaccgcacaacataccgggccgaatcggttttatcttccataattgcttttctttgatttaattgatctgcgaattgccttgcagacttttcatccttccattcccgaatgacgccatttaattgcacttctttactaactgtacgtttgactcgatattgatcctcatgtttctgaacttggtactccgtcacaccatgatccgcaacaaattgattcaaacgattcagatgctctttagccaacagcagttcgtcttgcatgccttctatcgctttaagacattcctgataatccggctttaatttgatctgtccatttaacagattagatcggtgcactccgattgcattggcaagccattgtaacgtattttgatccggattgaacactccggcttcaatccactttagctgctccggcgaaatcagacagagccttgacaactgctccacggacattccaatctctttgcgtctttctgcaatcagacttccaaattttgtaggttcctctaacgggaccagcttctttaactgtccggtctgacattgcgtattcagccagtgttcaaactctccggtcttttgttctggatgccgaaaaagctcttccaattgctgtctggacaaaatttcttccattcccttttgatgataagagtacaattcttctagtttcgtagatggttccatgaatcttcccccttatcgttttgggatcttttccggtgtcgggatctggatgctgttttcgtaccattttccttcttgatacatttccagcccggtctccttactccgataccgatagatatggtccgacaactgttccccatattccacctcactttggttgatttcctgaaccattttttcatactccgcatccggctgatcaaattttttaggatcgactgcgatcaactcgtgcaccgatgacggcaggatatagaactcaccctgaaagatattctgaaggctttcatcacgttcggattcataatatgcgcagccccaaaatacttgttggaatttgtaacaacatacatcggaaccggaaagacttctcgtaattcttccgcaggtagaatagctgggattatattttcatcgatcagtacatcagttatagacgaaatcaccggtttttgctctatcagattttttgcagcaattcccagtatttcttttcctgaaagattcatgattgaacaaaggtcataattgatatcaagcgacagattattcgtaatctctactaccggatagaatgcaagatcctgaagcttcatatagggtttgtccgctaaaaacaccgtatttctttcccgattgatcgcacgcagcgtaacacggttcaaaatattctcttcccctttcattttttcaacaagcatttctatcaaattctggccgttggcaacaatatccacataatctctggctgtttttttcaaggctgtttccggataagaataatcatatgcatccagatatagcattggggatactgccactcctttctgtctaactaccagaccatcttggattattccatttcttttattgacttcatatacttttacgtctgcctgctgatactcctgtggtagatagtcctttatatgctgctctacatattgattccgttcttttctattcatccttctctgcctcctgttctgcttcatacactaattgtccatctaaaaagaatgcttctctttctactacagccttctgagtctgatgaaacttaccgtacaactcccacatttttttttgtattctcttccatatttttgctcctttctatccgctttttggctcatactttgatagagttctaatttctcgttgattcgtttataggtttgaaaaacctgttccagcagatgatccattttttcttcagcatgatccccaaatcctttccacacaatttgataatgaacctgaaaatgtctctttctggattctgtcacttcaattcccatgttccactgcagcatcatggatatcatgtccgctcgtaattccgcttccgctctgtccatctcttcctgataggtgacaccatgtctaatttcatggcttagcgtggacagcttctccgtatcgttcagaaggtggttcaaaacaatttctttactgtcctctttataacggtaaaatcctcttaatgaaatggattccatatcctgatccgttaccctgcaatacagttcctcctccgcaaatgctgtcaaaacctcaatccatcgaccgtgctcttccgaatttcgtcccatctgaaacagggccgggtattgttcttttggaaaattagtctgggaaatatcgaaaacattaccaattccataagtcaagatctgtttcccctggatttcccctcgttgataagctgctctttgttctgcagttgccagtttcaattgcactgcttcttgctgatcaatcatcaggtatgtcacatatttcggcacatataccctgattcctttctgtccttttacactgactcccatctgtttccatgcactataagactgtacaaacgttgcgtttggattttgctgataaatcatctgggtgttccgaaggctataatggtaaaaccgacttccaaactcaagaaattccataatctgctgtgggtcctgctgatacttggaaaattcctgcaaccacgctttcatctgttccttcttggcttcataccccgctttccatcccggttcctttttctccattttccatcatcctttcacattgtctgcaacggactggatctgtgattttctccatctccgggtgcattgagacagaacagcccttccatacagctgttttcggacagctccaccgatagtatgcgccttcttcgtctatcagataagcacatgcttctttgtcactatatccaatcactgtcatctgcgccaaaataccttcaaaattttctactccgatacagtttccctcctttctccacgggaatccaaacaaatacaacattgcctcccgctgttccctatccactgtggaatttttctgaagctgcatggctaacagatccatcatggcagcttcccttctcttgtaatcaaatcgaagatccgaaatcaatcctccatacttatcggccaattcttccaataccccatgtaatccacctctttgctgcaattgctttaatcgtctcattacgttgacactaaaattcggatctgcaaactccataatctgtttgggcgtcagtccttcttccagacagtcaatcaaaaaatctttctgctcatctgacattttttcgttcgtcaacagtccttccagctccttttttcttttccgataccagaactgtttcttggctcctcgtgttaaactgaccgcctgttccctttttttctggtgtttcagttcttcttcaaggaactgaatccgcttctccttttcttctatcagatgtttgtatgattctgcttctcgtttgaatgcggtttccagattttcttcaaccaaagttctgagctgttcgctctgttttctggtatccgtaatctcatttttcaacttcagcacttcctcacctaattcgtcatgatccgtataaagattctttagataaaaaaggcgttcttttctaatctgactggtactcatatctttctgctccatctcctgcagatccttacaggacatgccatccaatgctgccagataataccattctctttttttccagtccgtaatactctccagaaacgaaaccacgtcccggtctaatccaatatttcttgcaatgacaatctggcactgtaaaacctgctcaattaacgtatcctttcttggtgctgatttttcctcggacatgctgctcctttcttttgcatttccaatgctgcttcttgctctttgcgttctttccgtaccattcgcctcaggactttgacatccggattttcctttgtctccctttcctgtgccatgagcagaccgcctgggtattgcctctccaattcttccatttgatctagtatcatttccatttggtgatcatccattgtctttttttcaacttgttttcttaaagcctgatatttctgacgcacggcaagttcctccgatccaagtccagatttcccgctttgccgattttccaaacggagttcctgatatacagcttccgcatcttccacggaccgaattccgtacttcagcattacccccacttctgcagacaaaaagtggatatgaagcaattgtttccggatcgcactttgattcactgcatagggattcaagtagtgaaaatatctgatacgatataattttttcacctttcgtatctgataacgggactgaagccggctgcagagtttcccttttttcactgcttttacgatgggcggcatctgccggtgtttttcctgaagttggattcttttcttgatttctgcatagcgatatcccattccaagactgcgatctcttcttccatgttttgctcccggtgcataaaaagtcaggtatgtttccgttttctgccaagtaccataccggatctgatacccatcctgctttagccggccacaaactcctccatagtcctggatcgtgaaatcgcatagtcaatatccatctggataatttttttccatgtcatcctgccctctttttctgctagatactctccgtactgttttccggtacgttcttcttgaaattgaagtttcatcagaccatgcttttcacaaatccggtctgccattggctggatctgtttttcccagtctcctttcacatagcgatacttatacccggttaatctggaaaccgaattgaagcaaatatgagcatgcaggtgctctttgtcattatggacagcaaatacataatcataagcgtctcctaagtatgcttcacaaaattcttttgttatttgatacacctgcccttcgtttccttctcctttggtaaaagacaagacaaaatgatagccttgcctcccatccagtttttcaaaatcccgttttgtgtccatcatagtttcataaatttcctgcgcctccgttccacagttcccacctatccatatctgatgttccgttttttcttcattgagaatataacagatacaggcataaagtcctgccgacggattcccttgttttcgctctttaatgtgcatcaattttgtaattgccatactcacttatctccgagcataaagctgaatcagttctttcagcagatcctcaatctttttctgctcttccttgagcacttggatatcagaaagttctccaaactcagaatccatttttctcgtgacctgatgaatattgattccgatttttcgaatttgaaaaatcaaatcctccatctttctttcaacccgaattgcatttctttccggcattaaaaccctgtttcggataaacttactgatattgattgtcccgctcttcgacctgcagtctggatcatgttccgcttcactcttaaccatctgatattctttttctgatagtcgaattccaatatatttttcttttttacatgagttcatcgccggaatcatttacatcagccaactctctttcagcctgttcgccattgtctttttaacttggtcatgccatttttcaaaatccatttcattcctcctgttacaacaaatgatcaaaagtatccagatcaaactcctcattgatcttttgtacatgttccgtcttttttcccttttgaagttgagaaagaatttccattcccagctgctcgtttttgtgcactgcacttaggatagattccagtttttcatctgttttgtcatctggattctctgcgaatttcctgactgcagattccaaataaaattcccttgatgggtatttccgctgatctctgtgatccatcagttcaacaatatcctctgacagccggaatgttttctttattttcattccatccccccctttccctttatctacaaaaaaacaagcagcctcaactgcttgtttccacttatactatatcattctatctctcgttcctctaggtttctttaggttcctatcaggtagtccccctactgtacctgatgtatggctttctgccattgcaggatgtccgactgccagttttttgtatggcagactgccagtataatacgatatgttttgggcaagatacgcattttgtttaacaaaatgccatcttattagggagtactgttccctaataccctttttaaatccacttttaatttcttgctctctatgtatgccaaaatattattcatttattttaattatcttgtcaaaccaaaccaaagactcctctttatgtgtcaccacaattactgttttatctttttgaatagcccttaatgaattgaacactatattttctgttttctgatccaagccacttgtgccctcgtctatcaccaatatttctttatcttgtagaaacaatctagccaaaataagtcgttgtctttgacctcctgataatttttctcccctttctccaataactgttttcaatccttctggcatttttttaatatcatcatatattcctgctttatggcacgcattatatatttcttccatactagcttcttctttcccataacgcaaattttcttctattgtatcattaaacaaaagactatcttgcataacaaatccgatacttttatataatgatgataactctattttttttaaatctatccctgatagcaaaatcttcccctctgtaggtatcaaaatacctgccattaatttaataagtgtagattttccgcttccactctttccaataattgcaacatgttctccttttctactacaatatatttatggttaatatcccttacaaccagtaaggaattatccatcttgttgcctaagctgtataatgatagagcaataggtatgtcgtcccctttcttggacttcgcgtccgtaaataagactgataaccagctcctcatttgcagcattcgttttatgcaggttgaatcgccttaggtgaattcgtgtcacaccacagtagattgaataggcaatgagtaaaactggtgcttatccattgcataattaaatcttaaggagtgacaaatttatgaacgcagtaggtatcgatgtttctaaaggcaaaagtatggtcgctatcattcgcccccttggtgagattgttgctgcacctttcgagatcaaacactcggctagtgacattaagtctcttgttaatcttatccattccgttgagtgggaatcccgtattgtcatggagcacaccggacgttattatgaagtcctggcacatcaactttccaaggccgaccttttcgtcagcgccatcaacccaaaacttatcaaggactttgacaatgactcccttcgtaaggtcaaatctgacaaagcggatgccgttaagattgcacgctatgcacttgacaaatggcaaaatctaaaacaatatagtgtcatggatgaattacgcaatcagcttaaaaccatgaaccgtcagttcaacttttatatgaagcacaagacggccatgaagaataacctcatcggcatccttgatcagacctatcctggcattaatacttactttgacagccctgcacgtagtgacggcagccagaaatgggttgattttgcatccacttactggcatgtggactgtgtccgtaaaatgtcccttcatgctttcatagaccactatcagaagtggtgcaaacgaaagaagtacaacttcagcctgtcaaaagctgaggaaatctatggaaaagcaaaggagcttgttcctgtacttccaaaggatggaattactaaactcattatcaagcaagcggttgaccaacttaacagtgcctctgtaactgtggaagaattgcgttccctcatgaacgaaacagcctctaaactcccagaatatcctatcgtcatgcagatgaaaggcgtaggtccatcacttggtccacaactcatggccgagattggcgatgtaacccgtttcactcacaaaggcgcgctcacagcttttgccggcgtggatcctggtgtaaatggttctggctcttatgagcaaaagagtgttcccacttccaaacgaggctccgcagctctgcgcaagactctgtttcaggtaatggatgttttaatcaaaaccatgccccaagatgatcctgtttatcagttcctcgataagaaacgagcccaaggtaaagcttattacgtctatatgaccgccggagccaataaatttttacgaatctactatggtcgggtgaaagaatatctttcatcacttccagaatccgaatagtttcataacacttctcttcagaccagcacgagtgtggtggtcttgttttgatacctatttttcgacctgtataaaattttcaattttcataaatttagccttgactttttatttgcaggcttatttgaaaatttatatgctctaatacattttttttcgcatctggatatctataagatacatctagaaattctatcgcacttgaaaagtttagatctattttttttctctagatttcatgtgtatcatttgaagactttctaataatctatcagtataaactttttgagcttccaattctgcatctgctcctgatatatttttcacagcatcagaaaacatcgaataatacatggcaaataccaatagctgacctatgtccaacttttgaagtataataagtattcctccaagaaaatataaacaaaactgcataaaaaactcatccttaagctttggaataaccaatctccttgcagtccagcagttaatccattttgcgttataaatcatatcttgatgtgcaaacttatagaatcatctggattcatgttttgatatatcaagcgcttttacttctctccagccaagcagatcttcgtgaagccatgtcatccattttttctgatttttatattgttccttcactattttattttcatagttacttaccaaatgatccaaagcaaatgttaacggaactacaatgctagaaaaaactgccaatctccaatcaatgccaaataataaaatcacacaaactcctgctgtaatatatgctaatatatagttaatggtctgagattccacaaatttatcaatatgttttgtatcatcttccattcgcatttttaaatctccaatatcaatcttttcattcccttcaagcggaacatcaagaaaataactcaaaatgttgccttttaccgcttttgtaattgaattactaagatgaattttggtagcaatacgaaaatattccattgctgtttcaattaaataaacccctaaagatcccactataacaacaagcagctttcctttttctctttgaataattaccatatcaataaagattccataaagaattggtttcaaaaactgtacactcataattatcacatcagcgatatttaagattaaaaaatagcgttttattccaaatgcataggccttcaattgtttaattacgttaatacgatatataatcttattaagcattttctttctcctcacttgtaaacaatttctgaaatgcactttctgtctgattcaacttatctaccgattctacttcaacaatttctccattattcataacggcaactctatcacatgctaaagccacttctttcctatgagttataactattgaagtcttatccgaaaataattttttccaataacgcaaaacttctttttctgtttctaagtctaatgctgatgtagcctcatcaaaaataataatcttagggttttttaaataaattcgtgcaatagcaattctttgtttctgccctcctgagagattaataccattattaccgactaccgtatctaatttttctggaaatgaatgtattaattcttctattccagcggccttacatgcatcccaaatttccctttctgttgcatgtatattccctagtaaaagattttgacgaatagaaccactaaaaatcaatacattctgctgaactaagccaatttgatttcgaatagactttaaactacactcatttaaagattttccatcaataagaattttacctttttggagcttataaaaaccaagcataaggaatgctattgttgtctttccacaaccactttttccaaccagtgcaatgctttcacccggaaaacttattaaattaatatttttcaaggtaatggattggtcattgtatgaaaagtataagttactaatttcaatcttcccttttgaaacctgtaaattgtcctttccatcccatactttctcagttggtgtatgcagaaaatcatatattttttgaatataagatattctattctctgaatcaagatacctttgacttacagaacttacattcctggttagatatccataaaacgtcaatattacagttaatacaccaacactcattgtattttcccaaaccataacggccgataaactataaaggcataatttaatcagcaaatttataagcgaaataacactattggcattcattacagaaaaacttgtttttttagcttcatataatattttctcttcttgcacataatagtctcgcacaactttttttgtgcccctaaaaaaacaatctcttttagagagtcaatcttctccaaaagccaccccatgtacgcttgatatgctttactttctttttctccatgattacgaattcttttcttaaatttaaaattaataaaagtagagagaggtgctgatataaccgataacaatccaattctccaaagataaaccgcataaattaccatcataatactttcatttataatatgtattatgtttcgaatcacaaaatgcatacactcttccggataatcctgcaataaagtaatattttctcctgagcttactcttgataaataacttgcgttacattcctttaaatgctcaaatatgtctttttttatctcaaagcaaaacatattcaacagatacccatgctgtgaatagcaaagaaaaaacaatacacaagacaacaaacagcatccaattaaaaaaatgagagttgaagaaacgtattaaagttatgataatataccacttcatcaatcataataccaaagacaaccggtaagagaaaatttaaaaataattcaaatactcttcccaaataaaacatgataaaatttttcttatatctatctatgtatttttttaaaatcgaatacaggaaaagtaagttaatttttctttcatgatcctcctcctacctttataaataatatatgaataagagttcttttttctgtgacaaattccaccgttacattgcctgacaatttattggctttgttttgcatagtcaagtatgtttgtccattttttacatctcttgacaagggcacacaagacgcagttaaaaagtgcggaatggaaaatgcttagattttccattcaatctgcacatactcgcttgtggcctttatttgtgttatcaggccatcaatgacttttcttctgtcctcaaagctgatattttcccagttgtgaatatggctggaaagttctctaatctgcctcggagacataacttctgccgataggtcggcaatctcttttacaaggttctggcgttttgtgtccagcgtttcaattttgctgttggcgtaggaaagaagaatcggatttgcgccgctcaaagtatcaagcagcttttcaatttcctcatccacttgtgccaattcgatttgaagggctgtaatcctcgggtctattctgtcctcatttcctcctatcaggctttcaaactggcccattttctttgccatttctccgaaaataaaactctcaaagtcatgggttttcaatttgccacagccttcacagctcttgttgtcggcccgtttggagcatctaaggtattgagtacccgtagaatttccgacgctcattaaggcatatccgcagcgcccgcattttactttcccggccatccatgtatttctggccttacgtccggactggaatgtggtattgttcatcagcttcttacggcatttcagccagatagaggaaggtacaaaacctttgtgcggagcaagcacaagtatctggtctcggagctgggagtttttattccctgccacatcccggccctgatagagataacagccgtttcctccctcaaagtcagccgcttcgttgacaatgtatgtaccttgacttttgaaaaactcgtaaacatcaaggtcagctatcacataagcggggttccgtaaaagctgtgagagaaatccccgtgtcagatctttaccgtatattttgatacctgcctccgaaaagtaccgggtaatatctccgaaagaagtcattggctcgacatacatggtaaacatcaataaagcgtattttcttgtttcggggtcctccaccagcattttcgtccttacatcatgcagtctggtaggcgcaaggtcaaatccgtagggagcggggccgctcatgtgaaatcccttcaaacaccgggaataataagcgtccgttactcgcttttggattgtctcacgttcaagctgggcaaatacaatacagatattgagcattgcccgtcccatgggcgttgatgtgtcaaacttctccgtagaggaaacgaactctacattgtatttctgaaattcctccatcatggtcgcaaaatccagaatggagcggctgatacggtctaacttgtaaaccactacttttttaatcagacctttttgaatgtcagccataagctgttgaaacttcggacggtctgtattcttaccagaatagcctttgtcggtatatgccttatagctttctcccttcaattcatattcgcaaaattcaatctggctttctatactgatactgtctttacggtcaacggactgtctcccgtaaactgcattgattcggtttaacatggcggttcctcctgttcgttggaactgccaaccttatgattatattataccatcgacagccccttatcacaatgttgcgaatgattagtgaaacgtgtcctcatacttgatgaacacgtcaaacaggcacctttccacttctcttttgcgctgttccctcgccttcggagcaagcaccggggtaaggttttcaaggacaatcggctttccttgaaaaatcgccgttgttgtttccttatggtatgcggttgcaactgcgttcataaaaatccctcctttagtcccagatcaaccgttgctccgcctcccgtagtctcatagggaaacgtcaaaaaacggcaccccggaaggtgccgccctttgaactttccccagcttcgggccaatgtggcccgaggtcggtagttaccatttagaatatttctgttcggcttcgctgattgtatggaagtcaaagacctcataaagctgtcttaccacacggcgaatatcctcacgggaaaaaccacagtcctgcatagccataatcacataaccgcggcaggcatcattgctccacatatccggctctaatcccggaatagacagacagttattttccatagtgatctccattcattaaaatgggggaggtcctgtcggcaagtttggcctatcgtcagacagcgaagccggaggacctccccttgtttttatttccattccagatacccggacgggcggtgtgcttgtccgccccataggaatttcacctctccccattctgatggcaaggcgttctcattgcctgcgacggctcacggccttctggccgcttcaacgctcggactgtgactgaacgcaagtatcaaggttcctgtactttatccggcaaaccagccacggcctgcctgcggcatgagccttgtcgctcttgccgctcccggaagatgatatttccttctgaaaacggcagtcatggcgggcctgtcactgggtacatttccccttcgtgttcgggtatcgtcttattcagttttcaaggttcttcaaggcttgtccttacctcgggccattgtggcccgaagtattttgcctctcataaaccatttcatttttcggcctaaatcggtacggctcacaaagaatttttcaaaattttttccaagtgacgaagcccgcgctcgattgccacacgaaccactttctcatggacaccttctgcccgggcaatatcctgtttcgtcataccaagaataaagtgagcgtaaatgcgttttgcctgcttgtccggcaagctggcaatggcggcatgaagctcctgcatagtcactttgcgctcgtacagctcatggggagaaagtgcgacaaagacggcctcatgctccagaccatcatcccgatcaagggaatagtaggctttatgacgatatgtacgcagtcggtatgcagcctccttgcgatcaaattctttgaacatttcagcaacttcatccgatacttccatgaagtaatccgatgtataaaacgggtaatagtcccgcagattgataatagccatattgacctccgtttcggtgttgggtgttgacaagtgaccgaaacgaaggcggcggggagcggcaccggggaacgacttcgggccaacatgacccgaagcagccccataagaaggcaaaagcgcccgggcggcatgaagccacacggacgcatgaaatgacataatagttaaggttccaacaaatttcgcatacatagccggacttccccggaggcgggactatgctttttttagctggtgcagatcatagaaatgatagcaagacaaaatgaacacggcggcacctccgtagataccgccgtttcaattaagtatcaaatttaagcgtgcgaaaggtactgtcaaacagcggtttttttatttccttatttgacagcagctttaatttgaatatagcttatttcgctacgggcaaaagccctttaatttcgcgattgatttttgttgcaagaataataatagatataagggtaaacacatcagcaatcggctgggctaaaataacaccattcaattcaaaataatgcggtaaaatcagaatggtaggcacaaagaacagcccttgtctgccaatgcttaaaatcaacccacctaacgatttcccaagtgcaagatataaaagcgcatactctgttccaattccaaaaaagacaaacagtatgctgttgactctcaaagcatttgcgccaatctccaaaacagtagcgtcatttgaaaatagtgaaataattgcttgcgggaacaaaaacaggattgcggtcataactccacaaaaaatggttgaccattttccagtaaccttaattgcactccaaaggcgattatattgtttagcaccatagttgtaaccaacaacaggctgaaaacctttcataaatccaaaaacagctaatgtacccatcgccatcatacgggtgacaattcccattgctgcaatcgcagcatctccataattttgagccattcttgtagtcaaccacatggcgagactcgtgaaaagctgaaaaattaaatttggaacaccaaccttgaagatttgtccgaaaatttttccgtctacccgaaactcttttggagaaaaagtaaatacactttttccagtaaacaaataacttagataaataagtgttgtaatcgcctgtgaaactacggttgctattgcagcccccttaattcccaaatgaaatgtataaattaagagcgggtcaagaacaacattgagtacagcacccaaaagcattgctatcatagaaagttttgctgctccttcgctcgtcaaaacattattaagagttgtgctgataatcgtaaaaatcgcaccaagcgcaaaaatagaaggatattcaactgcaaaaggtaaaatcgtttcagttgcgccaagtgcaagaagaatatttctcatgaagatttcaataactaaagttgctattacaccaatggctaaactggaatacaatgcagttgaagctacatggtttgcttgctttcgatctccagctcctaaaagccgtgaaatgtaggaagatgctccgccgccaaaaagtaaccctaatccagataaaatctgtccaacagggaacacaacggaaatggctcccatttgttgtgtcccaagcccgccgacaaaacaagcatccacaatgctatataacccagtaacaagcataccaatcattgtaggaaggcccattttaattagtagttgcgggacgggcatttcccgcaacattgttatacgttcttcgttatccacttgagttctcctttcatgccattgttggcaagtgatttattatcgctccctattgggatgagcaataaccaattttataattccccggtactttgcatttagggtatgaagttgttgttcaatagcagaggatagttcttcttcctcttttctcaacttgtcaggaccttctattgttataaatacatttgaataattttttgatttttgaacatttaactgacttacttttgcattaggattgactttcagaagtacaatttcgataattgactgtatgcttttaattacttttgggtctgtttccatataggcaatttcgatggttgtttcacaagtaaactctaaagataattcatactctatatcattcactacgcttatcaattcgctgtattgtgtattttctgctccaacaactcgcatagaaattacatagcgacctaatccataatcatgaattactaagttgttgacagaagtgacttccttgtgggaaattgcaatcttttttactttttcaaaaacagcttgatctggcgactgccctaaaagtcgttcgacagtttcagtgatagccttccatccagatgtaataataaaaattgacaccaataaactacaccagccatcaacaataattcccgtataatgctggaaaatcaaagataaaagaattgctgttgtagctgccatatcgctaacactatccattgcagtagctttcattgcagaggaatcaattaaaacagcatatcttttgttatagagatacatatataacttgactaaaatagagcaaacaagaacaagtaatacagcaccactaaactctgcttcctgtggagaaaacacagacagaattgaattttttgctaggacaactcctactataaaaacaataagtgcagataagaaccccataagccattcataacggccatgcccaaatggatgattttttcctccgccaatagctgctaaccgaaatcctaaaaaggccgccaaagaagaaccagcgtccgtaatattattaacaccatctgcaacaatagagagagaaccacttattgtgccaacgataactttgacgataaataacaaaacattaagtgcaacgcctactgtactgcaaagagtggcataagactgttttactagtggtgatgaagtgttcttatagttctttacaaaatgcgttatcaaatatttaatcactatctaactccctcctatattaatgaatgtattcattcactgatatagataatagcacaccggcataaagaagtcaatattctgaatgaatacattcattcagaaacaaaaaaataaggaagtatggatgttccacacttccttatttttttgttagtataattcgtcccaaccagttccaagcatatcaggggtttggacttccaatgactttacaaacatatttttcaaaaaatctaagtacgacaagaaatattgtttagtgttttccttcggcatagcagagtgaattgtatgaataattccaaacgtaaatagtcgcgtggtatattcgacattagtacaatgaaatactccttcatttacacattgctgtacgataggaattaaaacagataccatattttctgctacattatccaaacggctcgcccgaatttcttcatcctgtttataatttgcttcaaattcatggtgcttaattgtatattcaaaaatccgtttaataataagattgaatttttcaagaggtgatacatcatcagatataggtattttaatttgttcgacggcttgttgagcatagtattcagccgacgcagcaaaaatttctgatttagacttaaagtatctataacataaaccttgcgatacatccattctttcagcaatatcttgaatggttgtattttcgtaccccttttccgcaaatagttttaatgccgtttcaataatttctctctttctttcctcgggttctttggtaatcctcgtgcgtcgtggacgtccagatttttgtcgatcacaactggttatttcctgttcttccgacatatccttcataccagccccctcctttctctctgatagccaatgaatatgttcattatcgcccatattttaagtaatgtcaagcacatgagcgtttgtcacaaagtttaatatgaaaaataatagacataaatataaaatgatactacattctcataaatcaacctgaaatgtacaatgatatagggtgatatgagaatgaaccaagacgaaagaaggtttgactttcacgggctcggaatggctctgaaacaggccagagaggaaaagggctggacgcaagcctatgtggcggaactggtcggcaagactgaccgcaccattatgaacattgaaaacaaaggtcagcaccccagcttcaacctgtttttcaaactcgtcactctgttcgatatttccgtagaccagtttttctatacagaaggtcatcgcggagagggcagttgcagaaagcatattgacgtgcttttaagctcgatgaatgagaaagaacttgttgttatggaggccacagccgaagggctcaagaaagccagagaaacggaggttcaggagtaagagcctccgttttttcatgccattttgagggctgccgctaagtggcaagcaatgcctttgtggccacagaccacaaacgccgcttgttggggctcgccccaaacccgtcagcttcgggccaacatggcccgaagtgatcgcgtcgctttgctccttatttttcatatcttcaacgctccatttctttctttttccccggctccgagtagccgagcaggcagtcgatattggccttgattgtcaaaacctcctgcatatcccgccgggccttctggtattccccatagagccgttttttcttcgccaacagcttgtggccttcttccttctgcacctccattttcgggagcttcgccccggcaagaagtcgcttcatatctgcctgcgctgcccagtaaagctcgatttctgccccatgctccgcaaggaatttccgactgtactttgacgctttgtatttgtcaaagacaggacgggtctttgcgtattgtaccgtggcggccttcaattccgtattggctttcagtgccgcctccgtctgcttaatctgaacggaaagagcatgaaagcggtcagaagtttcttccgcctttttctccaactggctgtactctgtcagcccattgtcctgcaaataggcaagggcggcagccatctgttttaagttgaaaatcttcgcccaccgctcatatcccggcccttttccctcggccagcttcgcctgtatgtccacagcgaggctgatttttctttccggcctgcgcctgtctgcctttccttcaatggccgccagtatatccttcaggtcgtagccgtcccccagcgtggaggcacgcagccgggtaaagcgttcctgccctccgtttgacagccgaaagctaagaccgcctccccggactttttttatttcatatccggactgcttcatcaggtcgagaaatttttccagactggcaggccgttttgccagtgcggcatcaatggcaaggcgaagcctgtcttgataggaaagcggccctttccgttctttctgccattctccgtaatgcttatatttccccttgttccggggcttcggattctccacaatggacagtccgttttcaaggcacagcctgtcagagagccgccgcagggcgaagctggagccccaaaagtttcggaatttccgggaacattcaaggacggtggaattgtaatagatatgacagtggatatgcttcttgtccgtgtgggtcgtcacaaggaaagcgtggcggccttttgtccagcgcatagccagctcatagccgatacggtttgcctcctttggcgtgatctccccgggataaaaggccatgcgtatctggtagcagagcacgtcattttcctttttctgctcccgtccggtcatggccttatagctggctttcgcaagaagaaattcatccgccaccgtgacaggatcacactcataggcagagatatatttcccctcggttttttctggatttttcccatagtccagacagtccttgattgctgccgctatggtttccccttcattggcatggcgtgtcaaaagtgtggttgttgccagaaaatcatccccttccccaagaagaaaaggcggcccggcaggagccgccttcccggcttcgggccatcatggcccgaagtagatgtatttagcttacaagaaacctgcacagagcagatttgccaccatccagcgcccagatcagtgtcccggctgccgcctgcaatccatacggggaaagcagaaaagcaaggaacaggaacacggccccgcctaatggggtaggcgtgaaaaagaggcaaaccccaaggacagcgacaatgaccgaggcaatcgtcaagaagaaagcacacaggtcaaagagaaaccagcacagggcggacagcagggcaagaaccagcacaaagggcgcggcgattacttttaatatcatcttcattttaaagacctccttctatctttctacttatattttaccatgcccgcctgaggacataaatgttgcgaatgattagtgaatcctgtcctcggacttcgggccacactggcccgaagtcattaaaaaagggtatctctacagatacccctaaaaatgtatgtttgttatagaattattccatagtatatttatcaattgctgcacgatataaattaattttttcatctgtaaaactaattcgacgtttaaataaatcatctaatttttgatatatatttttataaattattttatgtgcagtattatgcacagttgaatcatcataaatatccatttcaaaattttcatcctctatagcggcttgcaataatctcaaaatatcttcttttgtaatagtgtcaatgctttttctgctttcttcagattcctcaaatctaaaaaaaacttgtccattttcaattattaagtatttcatacgatgtcctccgatctatatacgcaggttcacctgcttctaaacaattcaacaatacgtcgcgtctgcttatcttgttaccttccagatcaattaactccgcgcttgatggatgtcctgagtaaatatgatattttactgagccatctgataagatttctttgcttgtataaataatataatccggatgtactgaaactccgattgtattgttatgagttgctattacaactgggatatgttgtgatatttctttcaacagagtatcgacaccatcttttaaaaacaaattatcaaaagaagattctggttcatctaaaagtaaaatatcacttctagttgcgtcagtaagttcttgtaaaagattgtactctgaccgttctcccccagatgcttgggttccatactggttaagaacattataggttatatgggcaaaaaatttgtagtactcagatgtcggtaaatcttctttaccctttaatagcttcaaaaactggtacggattttcatattggccaaaagcatctgaaaaagtcattcttgtgcggctaactttctgcatttctcttgcaccggaaaatggctctactttcgcaatgattctataggaatataaattcctttgttcaataattctttctttttttacaagctttgcaatttcttcaaaacgagatactttacttttgttcatcaatatcgtatagaaatcaatatctggaattggtgtggtagatgaccgtacttgtaactcgttttttatactcgttactatatcattcacatatctcttttgtagtatttcagtctgctctttgatatatttttttcgtaaatcaattgctagggaacgcagtgcagttggttcaatatgtctttgtataatatcttgatattctgaatttttgattaaagcatccactgcatcaatcaaattgaccagagttgaaagttccttagtgctatatagggactcctgatatagtgctgcccgagaaaaaatatcttgtcgcgaagcttcggttgcagcttttttcaaagccttcagataatcatctatatctttgttatcttgttctaaatcaattaaacgcacatcatcaaggactgctttcaaaggagagagatatttttctgctaaacaatccccacggtttcttaaggtagcattaaaactttcttgatctgttgaattgtctctggaaagcaatgaaaattgttcaatatatttcccatctgtaaactgttcggcaatttgatttaaggtataagttttgccagaagatctttttccaaggacaactgtaagacccgtagaaattttgagcccattgtctaacacttgaaataatgtatgcccatcttctgatgaaatcgaaaccttttcacaatctatcaaagaatattttaaagctgttaatgttatttcttcaatgtctatatatgtctgtctcccatctaactcggaaaatggttcagaggctcgccaatcactgaataaaactggtactagagcattatctcttttcttttgggataaaaattttttaagacttgaaacctcaccacaagtaacaaatttagcaatttcagaaactcttgaaagagataatttagggtctttgtcataatgcgggattagtaaatatttatttaattttccaaaaacagagataaattgttcttctgtaacaaagctagtactacttccaccattaaatctgtgtatttgttgacactttggaataaagtcctctaaatctgatttttctgtaattaccaaaagatgaccattttcaatatcaatttcaattccagggaaaacaggaattgagagttccttggttatttgctcaaattgttctacatcgaatatattatgatttgtaatagcaattgcatctaatttggcagtattaacatattgtaataatgcattcatagaaaaatcgaatgcatgatcgcttacagttgaaattgtatgaatgtgaagatctatttttttcatagttacctcggtacttttactaaatataattctattgcttctctgtttctgtatattatatctatattctacaattacactttttcttcgtcaatacaaatcctcgggccacattggcccgaagcgccaaaaaagaaaaggcggcaggtctcccggtcaaggagcctgccgcccacgtcttacttagccaccagctcggagagctcccggagcaccttcgccacctcgccccacagcttttcatagtcccgtttcaggccgtcgatctcctccgggtacaccccgtaggtgttggcatggacggccacctgattgagattgttggaacagcgccgctgtaaggaaacaagctcctttaccggggcaaggtcgatatggaggatatagccgtttaaggccatcttccgcatataggctccggcattggagataccagcctcggccatccgcccatgaatagcagccagctcgtcctccgtaaccatcacatggagatgaatattccgctttcgacccggcattaccgttccagttcccggcccttccggtgctccttcggctccttgaccttatctaacggcttcttatcaaactccggcggctgcgggggaaggggcgtgttgttcggcaccccgtcgatcatgttctggttctgctccgtggagagctcggcggtctttaagtaattgtccttttcgtgcatggaatccctcctatctgtccttatgggttttatggttccgtttctgtcccggctccttttgcagctcctgtccctttgccgcatcttctttgagccgggcggtgatcgagcgtttccagcccggattgtccggggccggggtcagctcatagtccctgatctgtttcggggtcagcggctttttatagacagcctcgccccatgcctgtatctgtccaccggccacgggcctgcgcctgtcgtcctcatagttgacgacttccaccagcgggttgtcctttgtgtccggggtagcccctatgtcaaagggccgctgggtggaataatagcggtagtattccccctgttcctgccccggcgctttttcctccaccttgaacagatattgataatcgtccacacggcgggcaaaatccttctcggcccattccctgtcgggatgataatggccccagtagtagtcccggacgccgccctcgttctccgtgaactgccatgtgacaaagggctgtggagctgccgggttatggccgagggcaaagcctctgttgttctcaaacaggatggatttttcgatttcatatccctgtacgttctccaaggtcaaaaacctcctttccggcttcgggccacattggcccgaagtgtcctcatgttacgaaatagaggggcagaccggggccgggcatattctaatacccatacaccggctgtcctccttaaaaagccagttatatcaagccctccggggaggcaaatcgtaacagccgcccggctttttcccccgcattttcctcatgcgctcccggcttttcctccggtttccctcggccttgcaggcttcggaacagtagctttgccgcccttcgggaagaaaggctttctcacagaccgcacagaagcgcagctctggcgctgtgccttctttggtaagggaggcttccagctccgggtttacgggaaggacggcgtttttaaaataccggcagtaagcccctgtccagcatttgtggagcatatagcaggggcagtctaacgggaggcacaggccgctttccccgtcatagttggcgcacatccccgtaacgaggctgcggatcttcttcttttcgtcacgggtcagctcccgggcggccattactgcttcgggccacgctggcccgaagtgcggggctttaccaccagcgcccggaacttcttgcggcactggttcttctttccccggcactccttatggtagcggcatccggcgcaggggtcgccgctgccgcgccccggccacggggtttccttcatcatccgttcaaaggggctgcttgtgaaattcaatcctcgtcctcctgttctccgtccatgtcccaatgcggcatatcctcattgtcaggttcctccgtatcttcctctatgacttcttccggggtttcttcctcgtactcgcagtagtcgtcctccaaatccggggcttgatgcttcggcttgtaaatctttaagtagtacccggccccgccgccgatcagcgccacggcccccacaaggaggatggcaaagagattgctgtccggggcatccggctccggttccgccacttcctccggggtttccgtggttttcggctccggttcagattccggctcgggagcgggcgtttccgtttcttcctcgctcttttctgccagcggaagaaggtcggcttcggtcacggcattgaggaagtacacgttgtccgtggttttctgcttgtcgatcaccagataaaagatgttctcgtccggggtggtgatggtgtaaaactccttgccgtcctcgtccgtggcattgtccaccaccgtcccggtgccgtccgtactgaacgggttctgggtctccggctggctctctgtttctgccgggggctcctgcgctgtttgcgtttcctcctgcggctcactgctctgggcataggccgggactgtaaaaagggaacagcataagaggctggcggccagaaccgcaagcctcatggatttagttttcttcatgggcgttttcctcctttccgggcgtctcggacttcgggccactctggcccgaagcggtaaaggcatgtttcgggtcacttaagaaggccatcagctcggcaggggtcagcttcagcgagcggacggcctgcacgatctggctgttttcttcttcctgtttctgcttttccagttcccggattttggcctgccactcggcggccttctccctggccttttccagctctttctcgatcttgtcaatcttgttcatgtatgggctcctttctgccgcctcacaaacgcccaaaggcataaaaatgagactgccagtagcttgaattgatgtttgcgtattggatgggatctccgcagtgcagcatcatcccgccgcccacatagattcccacatgggagaccggcacgccgctgtcataggttcccgtaaaaaagataatgtcccccggctttgcctcggaggacggaatgatggcgcattggttgtaaatgccctgcgccgtggtacggggcaggttatggacgccgctggccgtatagacccagcagacgaagccggagcagtcaaaggaggtggaggggcttgagcctccccacacatagggataaccgatatactttgtcgcttcggccatcagcgccgcaaaggacgggtcggacagggcttcgccgggtatctcataagaggggcccggggctccgccctcggtgtaaatcccttcccacaggtacggtttattcccttttagctcctgcatgatggtgtaaatttccttctgctgttcatcaagcctctggagaatgactgccgggagggtgcggtttgtgagcgtcacgttcaggatgtaatactcataaggcacttcctcgctggtggtttccccggtctccgggtcagtgctggtttccgtccggtagcggatctccacttcctcggtcaaggtcagctcatactgggcttcaaaaatctcccgaaggtccgcctgcacctgttcccgggtgtaaacatggtattttgccgacagataggaggccagctcataggggttgtgcccgatctcgtccacagagtagcggtattcatcatagccggggtggtcgttctcgatattcgcaacggtctgggaaagctcccattccatagcggaatagtcctcgtccgcccctaacaggtcgtcgtcctcggaggcgtaggaggtgccggacacggcgttgctgatcccgccgccaatcgtggtaaagagtgagcttgccgaagcgaacacggcaaacaccacaaacaacagcagaaggagcaggccgcccaccgggtgccgggccgcaaactgcccggcccgcttcgctgcgctgcccgtggcagaagccgctttttttgccgtctttgcgctctgccttgccgccgctttggcctctttggcatacttccgtttcagtttccatttctgttgtatccgggaaagggggctgctggcaagctccgggtgttcggcggccatcttctgaaaatccagactggcccgggcgttcctttctttgcgttcccactttgccacccggcgggccggatgttcccggcagcgccgtcttgcgtagcgggtcagcctccgggccgcgccctcggctgcaagctccgatttatgcgctccctccacgcccacattttcctgctctacctgatggattttgttgtggacatagaaccatgcttcggctctggctccccggacggctttccttacaagtccgggcggcttctttgccgcctgtctggcctgcgccttatccagtttttcacgggcagtatggagcttttccccggcccggtctgctttttcctgcgccttttggaatttttcgcttttagtgtcagcggttctttcctcctgtctgcggtctgtccggcggtttctgccgggtgattccggttcccggccagaaggttccccgccgcccggttcttcctgccgcatacggtcagaaggtctgggctggtcgccgtcctgccggaatttcccgccctttggcttcgggccatgctggcccgaagtgcccccgttcccgtccgggctgtcctcgtcctcaaagcggagccgccgggaggagccggaaggcgacgggccttcccgtatcttcgggtcagtctggcccgaagtttcctttggtggtttctgttttggttttctgctgatgggttacgccccctttcccggctcccgcttcttatcctccgggcgcgtggtcataatggcgtaaagctccgtgttctgcgggaagtggtctacaaaggggatggtcgtgttcccgaagaataaaagcccctcgccggaattggtgtgcgtcacataggaaagctggtgggggctgatgccgagctgtttggctaaaatctgccggtctccctgcgcctgcgacagcagcacaaggaagtccgagttttcaaagatgttctcgatctccgggctggcgaggaagtccttcacgttctgggtcagggcgctgggtacgcagcctttctttcggagcatcttccagatggacacgcagtagcttgcggtcagcgggtcacgaaggagcacatggaactcgtcaaagtagcaccatgtggcaatcccccgcaggaaatttaaagacacctgcgaatttaccaagtcctgcatgataagcatggcaatggtgcgaagccccgcccccagcttctttaagtccagacacaccagacggcggttcaagtccacgttggtcttgtggttgaacacgttgagggagccggacacatagatttcaagagaggttgcaagccgcaccgcctccccctcgggctgggaacagagcaggtcatacagggtttggagggttggcatttccgccgtctccgggtcctgcaagtgctcccggtacatctgccgcacacagcggtcaatgaccgtccgctccaccggctgcaagccgtccttgccgcccacgatcagctccatcagcgagaggataaagtctgcctttaaggccatagggttttcctcgtcaaaactcaggtcaatgtccatggggttgatgtggtgggggctgtccggcgcaatctcaatgacttgcccgcccagccgcctgatgagcggcgagtattcgcccatggggtctaccacgataatccggtctttggtggcgaggaacacgtttaccagctccctttttgccgcaaaggatttgccggagccgggcaccccgagaaacaggccgttagggtttttgagtttcttccggttcgccataatcacgttatgggataaggcgttgaggccgtaatagaccgcctccccatccatgcggagctcctgcgtcataaaggggacaaagattgccgtggagctggtggtcatgccccgctggatctcaatctcattgtgcccgagggggaggcttgagaggaaggcggcctcctgctggaagtccagccgttttaaggagcagttatacttctgcacgatacccgacacggtaaaaaggtcgttgtccagctcccggcgggtcggggccatgttcactacaaggaaggttaagaggaacattctttcattccggctctgcaaatcttccagaagggtctttgcgtcattgctgtacgtcacaaggtcgggcggaagaatgtccatgtcatatccggcccgggcggctttcttttgttcctccaccttcatcttgtcaatgtcggagactttggccttgatggatttcacggcggcggcctgatcgacggtctggatatggagggtgatcgtcatttccgcgtccatttccagaagctccgccagcagcttgtcggaaagctccgaagccaaaatctgcaaataggaggccgcgccccatgtggttcctacccggaacagacggctgaaccggaagtcaaagctgtccggggcgatgaagtcctttgtggaaaggccggttttcggtatcatatcccatgagaaatgaaagggggccgtcctgccggggtggagctgtccgtgtaaaagctccagccgttccagcccggaaagggagcgggaggccacgcccagctttttgaagttgccgcaaatatccgcctccacccgttccagtcttgccctggcagaagaaaggctgtccgccttcacgccgaaggtcacgagctttgtgcggacaatgccgttgttgcttctggcgatctggttgtccagcatttccacatactcctgccgcacgccgttgtactcgtcgtcctgcatggggatgttgacgctgtaccggctttccgggcggctcctgtggtttaagaaggagagctggaaagggagggtgctgtcaaagtagttgaggcaggcgctccacccgtcaaagatggcagcctgatcttccgcctgtgcgagctggtagttgatgtcctcatactcaatggttttcgtgtaatagttatccgccacccggcacaccccgtcccggtacatttcccggtaagggagggtctgctgggcggtggcaggaatgtcctttttcttttggaacaatccgaaaaggccacgcttttcaggctttctttttgtgggctttccggtgtctgcccgtttctgcaatcggcgttacctccttcccgcttaacagcgcataaaagttttccgttttgtagggccgcacccgcggatagagaaaacaggtgcggaggatgtttttcagcaccttctccaaaggaaggccgtcccgctcatacatggcgaaaaagaagaacgggagcatgaggccgatcatcaggagcatggccgcgctgttgccgagggctccccgggaaaagaaataggccgggagccccacgcaggcggcggctgaaaaacaaatgagctggcgcttcgttaggttgaaggccagcttcgtcttgattttggataggtctttaggtactggcacataggccacggttcacacctcctttgcgcttcgggccatgttggcccgaagttatcttgcggcctcttttgcgggggcctttttccgggcggcttcggcggcctccatgccgctctgcctcgccctccagtagcccgggttgtactgccggatggagcggttgatggcttcttcaaaagccgccttgtcactaatcctgtcggggatcttccacagctttttgtctaacagctcccgaagcgccacattttcctgcgaatcttcctcaaagcagaggtagcccttatgcttgaagccgcatttcttcgccgccggggagaggatggcggctgcctcattggcaaccatggtcccgccgtggcttgcggtggagaccagaaacacccccggacagagggtttcgcaggactgcacctgtccccatggggagccctccggcgcatggaacatcccgcccgtccggctgcggtctgcctgtatcagcgccgccttttccagaatggcctttaactccggggaaaaataggcgtattcccttaacacccgggcggcgtccccaccgcaggctttcattaaaagggtgtaggcgtcgctgtccgctctggtacagcggcccagaagtttcccgtcatagtagcaggccgcgtcatagcctttccgtctgcgtggcatggtgtccgcctcctttccgcttcgggccgccatggcccgaagttacctgtcctgtccacggctggctttggccttcggcggtttttccgcctttgcctgttcggacgcctcttttccggcctttaattgctcggagatggagggccgcccgctatttgcccgttccgccatctgttccagcttcgcctcataagcgccaaggacatctgcgtttagctgttcccggaactcctttgtgaccgggtaggccatatcccggtagccccctttgccgtccggctggctgggcatccccacgaacaggcccttctggccttgcaggattttcacgttttccaccacaaaactgtcgttgaacttcacagaggcgaagcccatcaggtttttattgggttcaatgacccgcacgctcacgtctaatttcagcggtgcggctggggcggcagatgtgccgccggttcctttttccatagggttctcctttcctgcgggaatcaggttcccgcctttatagtcatagccttccgcatggagaagggccagcgtgtccgccgataccttcccggaaagcgccagatcggtttccgccataaagcgcagggtgtcctctctggtaaattcctccgggagctttccgtaaaacgcccgatggggctgtctgtccgctcccagtttgtaacgccggggcatggccgcctcctttctgcttcgggtcatgttggcccgaggtcactaatgggccccgaagatagattttgacaggctcccggtcttaaaaagggtaaagcacagaagcaccgtgtagcctacgcagccccagatagctcccatggggtcgccgtccacggcaatgctctggatcagtacggcatagatggcgatacagaccataatcagaaagccctgaaagcctaccgcaaagagggagcggaagtaattctgtcccacatggcccgtctcccggttggagaccgtggcgaaggggatgggcgcaaggcttgtgagtaagtaaatctcaatcatacggccatacacgatcacaaagatcacgatattcagggcaatcatggtaagctgcacaaggaaagactggagccacagcccgaggagaggcccgacgtccatggcttcaagctccgtccgcaggctgtccatgacctccggggtgatctccgtcccgctctggataatgcccgccgactgctggatcacatgctggcttacgtcaaagacggccagcgcgattgtgaaggtattcgccagaatcatcacggccacaaaggtcttgaacgtccatttgaagaacatccatgtgtccacgtcatggaggttgttccggtcaatgagcatctgtatcagctcatacgtggcaacaaaggtcagaataatcccggcaatcggaaggacaacggtttcggatagctgccgtatcatggaaaagaccccggcgttccagtccgccggggtcgtacctacctgtacggcaatgtcccccacgctttggttgacattatcaaaaaggccgtccagatttcccatgataccatcgacaagcaatcctttgagccattccacgattgcgtcgatgataaagtccataaatcacctccttactggaaacggaaaacggggctccttagaacaggccggacagaagggggatgagctgcataccaatgaggacgacaccgccgcccgccatgagctgcttgattccctgtgattttgccgcagggttgtcggaaccgtagccttccagcaggttgataacgccccacaccgcaaggccagcgccaagagccataaccagaatcttcagaatgtcgatagcagagttaaaaaaatccatatagttttctccttttcattgaacgattgattttgggtacaaaaaaaccgcccataatggcggcgtcacttcgggccagcatggcccgaggtcacacgaactcgtcgctgtccagatcgtcaaaatttaagaggtcagcttcttcgtccgtgtccgtttcctccacctcgtacaccatgtactcgtcctccggctttagtctcaatggccggcggcggaacaggctttccagatggaaggcgtttttctttttatcaaactcggcggtatatttataattcgggtgcttcttcaagtcgtacttcggggacaggaagggcgggaggcccctaagctgcaagatacatttatcccccggcatggtggtgatctcgctggtggtcatcaactcccggccaaggcgctgcatgttctggctgtaactttccgactgcccccggctgcgcccttcggtctgcatggagatggtcgcctttcccagccagttttcagaaatgtcctttagggtggaagcctcccgcccgccgaggaagataatgctgtccatgttccccatgatagtctccgagttgtccttatagagcgccttgcactggctcatggcctgataaaagagggtcaggctgatctcccttgaccggataacggccacgattttttccagccccggcacctgcccggtgttcgccgcctcgtcccacagcacccgtacatggtggggaaggcggcccccgtatttgttatccgcccgctcacaaagaagattgaacatctgggagaaggcgagggccacaaggaagttataagtggtgtcggtatcgctgataaggaaaaacagcgccgatttctcgtcgcccaggcggtcaagctccagctcgtcatagctcataatctcccgaagctggggaatgtcaaagggcgctaatctggctccgcagctaatcaatatcgactttgctgttttgccgctggcgagcttatatttcttatactggcgcacagcgaagtgctgggggctccgtttctccaagccgtcaaacatgtagtccacggcgtttttgaaggtctcgtcgtcctcccgcacctccatgctgtttatcatttccaccagcgtattcatgttgcgttcttcctccggcccctcaaagacgatataggccacaagggcgcagtagagaagggtttccgctttggtccagaactcgtccccttcttttccgtcccctttggtattggcgatcagggcgttgacgaattttagcacgtcgctttccgtcttgatgtaggccagtgggttatagtgcatacttttggaaaaatcaatgctgttgaacacccgcaccttatatttctcccgctgtaaaaagtgcccgcactggtcgagggtcccgcccttcgggtctacgcacacataggagctgtgggcctgaaggagctgcggggtcagccagaaccttgtctttcccgagccggacgagccgatcacgcaggcgtttaggtttcgggcgttggccgggattttcgggcgcgtgttcatggtgagaaattccgttcctgtcagaatgacgttgttctggaatttcgggtcaacaaatggtttaatgtcctcctttgttccccaccgggcggtgccgtactcggcgtcccggcggaatttttttgcctttttgatttttgactggatgaaaaggtacatccccacggccccggcagcccccacaaggaggtcaatcccgccaagccccggcagataattctcaaaggctgtggggaaggtgtccaccatccccatgagctttgtgccgaagtccgcgccgggagcaatccggtaggccgtccccactttggagaagaaccagaacacaaagagatacggcaggttcgggagcacatggtttcggattttgtcactcaacgtccgtccttcaccgcctctctggttctctgcttcttcttcggttttgccctcacaagctccgtgaacctgcgaagctggccgaggattgaagtcttttcttttcctttgtggagcaccttttcgctgtatttccgcatggcctctgtaatatctcccgactgtgccgctttgaaaaacagcagatagtgcccgggagatactttgcggaaggcataatccacttcatatatctttgcaatccggtcaaaatccttcggggctcccacataaggaatagaagttttatccccgcggtggttcagcagctttttcacgctctggcggcccttcggggtcagcgccttctggtggtggcccttcgccgccttcacaactttggaaaaagcggaggccagcaccttccccgtcagctttgaggcccggatggagagggccattgtcctctggtttacttcttcctgcatataacctcctttccgtcaggactcccgaaaaccgggaggtcccctgatgtgtcgggggaacgggaaacctcgggccaatgtggcccgaggtctaacgctcggcatgtttcggcggggcctcttttggcggttccgccttcgctttttcgttctgttcccgcatggttttcaagatggacggcttctgcgccgcctgttccagccgttccagcccggagagggccttctggatggtgtttcgcatggcgagatggcaggcccggtcagccttataaggggcggcgatggttttcgccagctttcccatgggctttgcctcctgtacggcttctttccccatgagcgcccggcccgcatttttcaggtgcctcccggcctcatggtattccgccgacacggtttcaatctttttgatagcctggctgtcaagctggatggcgctttccgtggccttctgcatggacaaaaggccctgtttgagatggaagaaacgggccagatcgtcaagggccgccgtcccgcgctccttgaagtccgtaagagcctgcttgcagccgcttatgatgttttcttttaaggccgcgatctggctccgcagggcgtccgctttttcttccagcgcatggactgtcttttgcagggcggactttaacggggatttctgcatttcctgtaagtcctgccgcatggcggcgatctgctccattgtcccggcaagctgtttttccagctcctccacatggcgcacagcgtctaagaggtctttggcactggaataattgttctcctttaagacagccaaaagctcccgaacttccttctgttccgagagccgcttctgtctggctttactgataaaactccctcctttccgaacctcgggccagcatggcccgaagtgttatcgttcctgctccttctttgcggggggatgccgttccccgggcggctctgctacatgttcctgtaccgcctttaagatggacggcttcttttgaagctgggagggcttttctcccgacaggggcctgatacattccagacggtcagccgcccggatggcgttgtcggtaagctgtctctgccatgcccccacactgggagcccagcggaaaccgctgattttgagctccgtccgggtggcttcgtccggctttccgtcaaagaacacctgcaaacggttgtcctcccggttcatttccacatggccgccgtcaaactcccagccggaaaaatcctgctccgcccgtttggaaacttcttcgatacgggccttgatccggcggatttccgcgttattattggtaagctggtagctttcaaaaggcttcggggagctgcgccagcttgccgccatagaggatttcagcctttctatctggtcgggggagagaagggcacaatcgtccagcgtcccgtgtttccgatagtaagcgttgacctccttcataatgagctgggagcgttccagagactccagctttttctggagcttttcaaccgccgccgggtcgtcggcgctgataccgcccatgccggtactgcggatcttatcaagaagcccttgaatgtgccgccattcctctatgttggctctgctggcctgaacctgcttttccttttgccggacggggaaattggctggccctgcgatcatcacggaaggcacccttgcgtcaatggcaaagccatggttcatgttctcggccagcttgcgggcgtaggtatcaagcaggctgtcgattttttcatggtacatggggtcaacctttgctttctgccgttccgccacagaagcggctttatcaaccatggcccggtattctgccgttgcgctcccttccttatagtcggaaaagctgctcatttcctttgcccgccgggcggctgcttcattgatcggataatatttgattgttccacacctcctttgcgcttcgggccagcatggcccgaagtcttaccgtccctcatgggaaggccccgccttgtccttgtgtggagcgggcggaacctcttgaaaccgtttgagtgcgccgagaatggaatggacgggctcggctttttcgggataggcgaatatccggtgttccggcggtatgtcctgcgtcccgtggtaatactctttaaagcctgccggggccgccgccacatatccgccgggagcgaaaacgccgccctcattgatacgcatgtcccgtccgtatgcctcataatcaaagtaattttgaatgtgctccggtatgttgatggttcccagctcgtcggcgtacagacggcccagaccttcatcatcggaaacatccgggtaaaaacggtaaaggtcaaggttctgcgtcaggttgattaaatccttcacgctgcccgtgtgttttcccaagacaagagcggcctcaaaggtttccaatccgcccctgtcccgtacttcccgcagggcatggcccagctcgttcagctcgtcaatgttctcgtactcgtccagatagtcatacagtcccagcacatcgctgtcaaagctggtaatgaacacttcgctgtaccgttttccgtctatcccgattttggcaagggcggcctgtatctcctgcgtggtcgcaggaaaatgtactgttgttcccacctcaattcccatcatggggtacaaagctgtgttggttatataggcttcaaacatgggcttacccctcctttccagcccggtctgccagcacttcataaatccctgccatgatgtaatcggcacagggaagggcgatagcgttccccagcgccttgtagcggctggaaggacggatttcctcgccgtccgccccgtactttgtccacccttccggcagccccatgagccgctcgctttccgtttccgtcacaaaacggatacagccgtcctccggggcgtcctcataccagaaggagaagggtgtcacatcactggctaaaagagtgggaaaagggtcagttggtaatccgaagctgtttctaaaggccgtttcttcctgcctctttgccgctccccgcatacggaagcactgaaagggtcggacgatgggtactcgcccccctgtttcaataaaaggcgctcgatctccttcggcggaggcgcccccgctctctgtgcaaggcggaggaagtgggagcattggacggggcttaaacagtatctcggcagcacgccgccctccaaaatcggccacgacaaaaatccgctgccttcttgccagcctccgggctcctgcccaatactgggcgtccatgagccgccagcacacatcaggcgttccccctcgcaccattccggcgtttccccatcttcccgaaggaggcattggaacttcggtgtctgcgaaggcggataggacggctctaaaatccatccggtcatttgtagaaaacgctcccatgacgttttcccaaacaaggataactggatataggttatcagtggcatccctcatttcctgtatgatacgaaaagcctgatagaacaggctggattttgccccggcaaggccggagcggttgccgatcagtgaaaggttctggcagggggagccgaaggtcagcacatggacgggctcaaccttcccgccgtccaccttcgtaatgtcccccagatgttccatttccgggaagtgccttttggtaatggagatcggagccttctcaatctcactggcccagaccgggcgtatgccgcaccgggaggccgcaagggggaataccccgatcccatcaaacaggctccccagcttaatatccggcactgtccggggagccctgccccttcacgtccataatgccctccagcgtagtcgccgcgattccataccgggcggcaaccgcaatatcgtttttcacgtcctcgtccacagaatcgccgcagacaaggagcatacgggagcgtttgagcatatcccggcccatgtcgatgccgtccttgtgttcccccggcacgctgtcattgaggaaaagcgggaggtacagcttcgggcagatgggagcgaggccagcctcataggcagaccggcagaaatttgcggcaaggttcatatccacctcggggattccgctccatgccgctgtaatgtatgctaaaggtcgtttcattctggtttcctccatttttaatataagataagtaacagcagggtacgcccaacccctccgccccttcccccgggaaggggaacggctctggagaatttatatccccgtcgcttgactgtgataaagcataaccgggagaaatccgtcaagggtgcctttggcaccgcctgcggcggccctgcccttgactgattttcccggctatgctaagggataactggcgacggggaataaaattttatatctccagagcttcggggcgtggggcagagccccacaaagcctttcagcctcgggccatgttgccccgaagtttcggcttatttttccttttccgtctttttctccggcttctcgtgttccttctgctggcccttccagtcgtccagcagtttgatgatctggtctttcatttccctcggggtggtttccttcccgaagtatttgctcagttccgcgcctgtcagaatcactttgtctacctcctttttgtcctccatcataatgccgtcgatcacgtcgccgtttaagagcttcttttcgtccagctccctcatgcgcttcgcctgtgcctgtgacggggaggactgctggctgtcaatggcaacggcgatatagttctggtttttcttgctgatataggagagctccacggctgttgtgaagcccagcttcttattatccatgagcgtcataaggtcggggacaagctcattgagccggatataccgctgaacctgtttgacggccatcttgttgcgctcggccacgatctcgttggagcgtttgcctgcgtccttcgggtcaatctggcccgaagtgcgggagccctgatgtttgatggcttcaagctgcattttgagggccttcgcccgttcactgggaaggatttcttcacgctggtttaagttgtcctccaccatctgcgtgatggcttcatcatccgtcaggttgcggacgatacagggcatatccgcatacccggcaagctcgctggctttctggcggcggtggccggagacgatctcatagccgccgtcctcccgtggccggacgatagcgggctgggtaacgcccttgtctcggacactggacaccattgcccgcatttcctcgtcgtctcgtacttgaaacggatggttcttgaaagcgtggagctcgtccagcttgatatagacaatctgctcctcaccacggcggggcgcttctttgggcggcagagggtatttcggagtttcctcagacggctgttttgcccgctctgtgactggcggcttcacaacagcggagcctttgtcagccgtttttcccggaacgggggcctttggagctttctctttcccagcggcggccttgtcctttgcctccttccagatggaagtctgtttcggggcggtatcctttgcaggagcagcttttttcttgtccgccggggcttctgcctgcgtctcctttggaggtcggcccctgcgtttgggcggctccatcgttttgtccggctctttctttacggctttctccggctttgaagggactttccctttctctggggagggagccgccttctccggtgcagaagcggccttttcaggctgttttcctttctccgccgcctgtttcccggccatgatttccgaaaagttatagacggaaacattcggcgctttctctgtacctgctttctccacagggggcgcggcttttccgccgtccccggctgctttgtctgcacccgttttctccacggggggagcatcctttttctcggccccggctgttttatctgcggtctgctccgggggctgctcttttagcgtggctgcttcggttttcataggttcctttgagggagcctgttccggggttttgcccggcccggtgtccggcgctgccgtctccggggcttttgtggtcttttcatctggcatacacatttacctcctgattttgggcatgaaaaaagggacccgatttttacatcaggccccggtggggtggttcctcctttctccgccaagatacaaaaataccgcccgtagtctcgtttgggcggtactttgtataaggttggcagttcagtttttgtaaatttatcgtgtatgcccttgtcaaccgttgcttgtatttacattcaaaactttctctttccatacactctggcttttatctttataaataaagatttcatcatctatcgggcttttaattcttttatccaagataatttgattatccattaaaactcctggaagtgtttctctaacatctaatttgatgtagttggccacaaatataataaaaattaaaaaaaatattaaatatccataatacaaaattggtgactttatgatatatttcacaaaaagatactgccatctcttcctgttatcttttattttgtttcccaacatcttgaacacccctttgttttataatttctaatcaaaattagtatttcggaatacctattattatatgtattctatcagctacatgtcaataatgcttaatgtgttctttaccaccacctgctcggcaactaaaattaaataacttctattaatataaacttgttctttgtattccaaaactctacacttaaaataaaatacagaatttttttgggggatagcgcaaaagatattttgcaataacatgaggactcatttcttttcattctttgcaaaaagtctcatccttcgaaaaacgcaaatggataagattaattctcgtatcattgatactatgatgatcgctgacatgaacttaaagtcctactcaaacatatcttaccacaatgaagagctaaagtcactcactcgttattgttttaataaagtcgaagaacagacaaagataaaaagttatcttttaagactggtctatatttttttccagaacagaaaaaacttgttcccacacttcatatagcgtccgtgtatgctgtgcttttcgaatttctacgcactaatactgtcgcatccgcacacctcccaagactttctaatcaacttactgagacttagaaagttagatataaagtaaacgctaaataatgcaaaccactttctgcagacaacagggcagagagtactctgccctcctgatcagcatgaatcggttgtttatgaccgagatcaactccttataatcaacgtggttcctccttaaaatcactattgttagacaattgcaattactcattcataccttgataacatttatcaatgcattaccgaaattaagaatttcaccgagatagcgttgcaaatgagtccttgaattttctgcaatttatttatattctataaagttacataagtatacagtgacgattatagggaagcattatgacgaaaatggggaaattgctctccgaaaacaccgcttacgcgtccggatgggggcaccatgtttgttatagacatggatttcttttgtaccaacccggatttcaagttcctatcacagatatttccggggcatgctataatgaatcttgacgaaggtgaaggaaaaatcttgtgctattttagcagtctttcgttcaaaatattcaaaacagctagtcgaaagatgtaggagggtctctttttcttctgttgtaaagagatgtaccgggaataggtaagtccttcaaagggcttccgattctcggcattcacctcttccatctgaacacagtttaaatcatccagcgaatcaaagaccatatcttccatatccatcagggattcctaattctttagcagccttagcgccgccgatatctttggcaagttttactgcctgtactttgtattcatggtcatatttgcgtgccactttgaatacctccttattctcttgattttattatgaaatccctgagaataagctgtcaacttttttataccacaccataatgtgtgaacagcgaaaaatttaaacgactgtggaatttaactctgaactggaatttaaaatttcaagtcagctaaaatttttttagacttgacttttaatagttagtctttccgttctataaaagttctccataatgccttacatatgcttttttcaaactggtggccagcgccatatacaataaaatacaaggtatcaaataggcgaaaaatactgtcggaggcgcaagaaagcccagcaaacgtccaaatcctgtaaacggaatgaatgtcagaactgcaatacctgtaaacgtcaataaagttacaggcgccgatgccatactctgaataaagggaatcttcggtgtccgaatcatatgaatcacaagtgtctggctccacatagattcaataaaccagcctgcctggaacattgccgcataatcgctctgtattctcgccagctccgctcctctataatgggcagccaaatcattatacaggattccatgtgatacaaactttggacagaatacgaaatacataaaggcataggtcgtccagtcaaacacagaactggttggcccgatccagatcataaaacttccaatggaagatgcatcccatgtcctcggctgtatcaaaaattcctcgtctacattatcccatggaattgcggtgcaggataaatcatagatcaaattgagtaaaatcaggtgcatgctcatcatcggtaagaacgggagcaatgccgacgctgccaataccgaaaacatatttccaaaattggaggaagctgtcatcttaatatacttgatcatattggcataagtctttcttccttcaatgatcccttcctccaataccatcagatctttttccagcaggataatatctgcggattccttcgcaatatcaaccgccgtatccactgatattccaatatccgctgatttcattgccgccgcatcattaattccatctcccatatatccgaccgtatgtccgttatttcttaatatcgttaccacacgggctttttggtctggagaaagctttgcgaacacgtctgttacttccgctgctttagcaagctggctgtcattcatatgagcaatatcttttccaagcagcatattccgtacttccatccctacttgcttacagatacaccgggttactttttcattatcccctgtcaaaatttttgtggttactccgtatttctttaaagccagaattgcatctgcagtggattcctttggcgggtctaaaaatgccagataacctaacagcaccatgtcacactcatcctttattccaaaggctcccaccggggaagggttggttttctgtgccacagcaatcactctcatgccatcttcattcagatcttctactttcactaaaattttctttttcagttcttcggtaagcggctccacttttccttcatactctacgctggagcaaatagacagcatttcttcgactgctcctttggtaatcatctgtgtttttccctgtgtatcccggacaactgtagacagccgccttctgctgaaatcaaagggaacttcatcgattttttcatacgcctctgacaaatctaaaagctgcggattttcggattcttcctcctctgtcttttgaatgattgccagatccatcaagttcttatacccggtctggaaataactatttaaatacgcatggcgcagaacccttacgtcctcatttccagtaacgtccatatgatattctaatactactttatcctgagtcaaagtgcctgttttatctgtgcataagatatcaatggctccaaaattctgtatagaattcaaattctttacaatcgttttcttttttgacatggaaaccgctccttttgcaaggcaagttgttacaatcataggcagcatttccggagtcaaacctaccgcaacagaaattccaaataaaaatgcttccagccagtctccttttgtcagtccattaatcataaaaacaatgggaaccatgatcagcataaaccggatcaaaacccaggaaactgcatttacacccttggtaaaatttgtttccaccgcctcctgggctacggatgatgccatagaaccaaataatgtatcatctcccaccgccacaactacgcccacagcacttccgctgatcacattacttcccataaaggcaatattcgtaaaatccgtaacggaaacggattttccagagcatacgtccgccgtcttttcaacaggatcgctctcccctgtcagagaagcctgactgataaacaaatcctttgcctctaaaatcctcagatctgcaggaaccatatcgccggcagataaatggacaatatcgccaactaccgtttcctctaatggtatttccattttcgttctttcttttctgtctaccgtacaagtcgtggtaatcatcgccaataatttttccgctgcactccctgaacgggattcctgtacaaaccgcagcgttccggaaatgaacaccatggtacagataatgataaccgtcaagggatccacatcttccggtgttctctgcatgattggcataataatatccgtaatggcagatacgacagctaaaaaaaacaaaatcgccgtaaatggattgacaaaagcacctacaagcctctgaaacaatgtttttttcttttcatgggtcactttattctttccataggaagaacggctctccaatacttcctcctctgaaagtccccgcagcgttgtattcatattcagtaaaaccggtttgattttattggtcgccacaaattccagaattttatctgcgtgatcccggcgcacccttctttccgcaatttttttcgtattgattctcttatcttctcttgtcatagcacgcctcctgttcttcctgatttttcaacaaatatcttttcgatttttccatatcgtatacatcaattcccgtcaaaacaagccatgcaatcatacaccagacaaacgccttttcctgaaatcccggaaaccaggctgacatttcaaaaatgattcccgcactcataagtactgtaccgacattttttcctaaaagactcatattgatcccttttcgttccttttctgaaagatttttccagcctttcagcattggaattgcttttccaataaaaaagaaaaagccaattccgaaaaaaagtaagcctaaaaccatacattgcagtctcatctctatttcctcctctcttttgcttacgagaaaagtatactgaaagcaaggcgagaatcctatggataaaaccttgcgattttcttgcgatttggcatgatttatattgacgaagaatgaataatcaatttttaaacatatatttttctctgtcttattgtaaatccctctgaatcctgcttcataaagaacgcataaaaataacggggtaaatccgactgcctgctctgtacaaatcctgcggtgtttagtataattatcatcaacctttaagaaatgagatgatagtttgcaagtataaatccaacctacaagaaaaaaccattcaaagaggtataaaatgataaccgaaaaaagagaaaaactgattttaaagatgtcctttttttctggacttttatttgcaataacggagtttatctttgccatatacagccattcccaatcatccttgacggacgctgtgtatgacacggcagagcttgtatttattgccctactgctgttccttaccccactctttcatcgaccagtttcggaaaagcatccttttggctactttcagattgaaacggtatttattattgtcaaaggtattatgatgttatctgttactctgggggtgtctgctgaggtgcttcattctaccctgtccggcgggaatcctgtggatagtgcactggtttccatattccagtgtattctgggaattgccagtatcattatttttgtaaccatgaaaaagctgaaccgaaacctttcgtcgccaaccataaaggcagaacttctgggctggaaactagatattgcttacagcttaggtatgtcctttgccttttttctgtcgctctatctggaaaagacacctcttgctttccttgctccctattttgaccagattatcgctgtcatcatcatggcattgattcttccagaaagcattaagattttgttgcgggctatcagggatatatttttattttcgccagataaggagctcattgaagaaatcaaagggctttgcaatccgattatggaacagtaccgatttgttcctgttttctacgatattacaaaaacaggccggcatttatgggtagccatttactttcagattgaaatgggcagtctcgccgtccatgatttatccgaagcattaaaagcaaccaatagaacggtcaatgagaagttccataactgcacctgtgaactgattttagagccgtaggcaggataacaagagacggccgggttattggatcttccatgttcctatcacttaaacggtatagaagaaaaatgctatatggatgataagttaccgggaaagaggctttccctaggagtaaggtcatagaagcaatccttatttatatagtcgttttcatactgacggaatttttaacaacagtattactacatggatcataaagaaccggaacactaccctgcgatttgacagattcgtgaaatacagtttccacttttcttctgtcatataagaaatatggattttgaagtaaataaccagtatcagcagtaatttttcaaaaaaattactgctttttttttcataaaaaaaagacactctatttcaagtgttctttttcctttaactgattgctgatagatactgtatttatacgggtgttctccacttttcaactgtttttatatagagaatagccttacccagattcaagtcatttcaataatctttttcttttatactattttttacctttaataaacctgcggcaatctcatcttttgttgattttctatacttgcacagactgtatacgaagcctgcaagaaaaatcatcaaagcaagaaagaatggatataaaaagttcaaccaacataaaagcaaataacagataaatacagaaataatagccgataaaagatagagagagattgcaaactggagaacttttctttcttctaggctaagaaaatatttatcccactctgacgaatttttatgtaaagcttttccctttattgccatacacaggagcaagaaacctaacataagtccctttgtcaataatatctttacaccgataatcagtaataaaagaataaccttactcatacttgttttttcctccttgttattgaagtcaagactgttcaacaattttaatcataacctgtgtgatgtactctttttcgctggcaatcgtataatcggtaagctcacgctcaaaagaatatcctgtaagcctaagtccatgttcgtcggcatagcttaacattttttcatatagctctggaagtctgctccacctacctttcagatacccgcacaggtacgctcccttgggttttgtcatagaaccgttttgcagtctatgctctgttatcacagtgtataaaccgtcatatttgtcaaactgtcctgcctgtatcttatctagggaaagatagctccccacgcctgctcgatactgttcaggcgtccagacgctttgtatatatgcaaaaactttcataggattatcttcttcaaattcataagggacagtcaacagatattcttcttttaattcggatatttctatacgcatatcactgatttgccggcaaaacagaagatgttcctttttctgtttcagaacagactttaccgttttcaattttctgatttccctgtcgatttccttttgcttactggatacaatttcaagaaatttctgttcatcaaaggaatgtataaaagctttgatttcctcaatgcttaaattgatttctttcagcatacgaatatactcaaagtctatactctgggaatagtcgtaatatctatatccgttctctcccttgtgacatggagaaaacaaaccgatatcatcataataatgcagtgtcctcttattgacgttgtgcaattttgcaaactgtgctgtcgtaagtcgtatagtttcctgttgcatgaaatacctccttgacattacacttactgaatagtttacgattagtatataccaaaggagaacaaaagaaaaggagttagacagaatatggaaaacaacataaaattaagagagctaaagaaacaggatttaccagcattggaaaatgtaataagaaaaacatgggactatgataagttcgcaacaccaaagacagcccgtaagctggcaaaagtctatcttgcgacctgtctgacaaaccagacctatacacggattgcggaagtagacggcgttcctgcgggactgattcttggaaaaaatatagaaaaacatcactgtcctttgaaataccgtctacgtcaaatctcggcattatgcgggctgctgatttctaaagagggacgtggtattctgaatttctataagaatgtggacgaaatatacagccagctcttaaaacagtgcgacaaggactatcggggggagattgctctatttgccctgtcccccgaatacagggggcttgggattggaaaaatgctgttccacagtgttttagcctatatgaaaagccagagcattagcgacttctacctttataccgatacaagctgtaatttcggcttttatgaacatcagggcatggtgcgccaacaacagtataaacatcttgtcaatatgaaagggcaaaaagtcgaactggaattttatctttatgatatggctgtatagcggcattgcaggctggtgcaaaggtgacctacgccagaggaatatatacaccatatggcaggaaatacccttctccggttaatatattcctctgctaagtttgtgcctccggtaaatgccactttcccatcaatcacaattttctttcattcctcaatcttcatttccttttatttctccgcatgaacacctaccaggccaattcccagacctcccggtccgatatgagctccaatactcatggtaagcggcatatagatacattccatatccggataatgttcttttaattcctgccggaacatagccagtttttccggttccatccaagtacttgcgattcccgcctttagtcgcccctgcttatacaaatcataaaacctttcctccaactctgcgtccagcgcctgacacatctttttaaaggccgtcttcattcccctgcattttgcgtatgcatccagcttaccgccttgtatcgtaaggattggtttcaaatttaacgctgtccccagtaaagaggccgctgttgtaattctgccgcctttctttaaatatgtcaaagaatctacggtaatataaatcgtcgcattcattgcctctttttccagtgtttttcgtatcatttctccggagtatccctgctttgccatcctttttgcgtcataaactgactgggcctgcgtaacagaaattctatgattatctaccacatgcacccggccccgaaaccgttcctcttccgcaagtaattgggcggtctggcagctaccgctcaaactgcttgacattggaatatagacaacctcaccatagtgttccaaaagccgttcccaactttccattaccacaccggctgatggctgagaagttgttacagaattaccgttttgcagccgttcgtaaaactgctgctcgttaatttcgtatccttcataaaatatctgttcctgtatgatgaccggcatagggagaatatagattccctgctctttcccctcttgtggcgaaatcccgcaattactgtccgttaagattgctatttttttcatctgcgcctcctgctttccttaatattggattcatatattcaggtatataagtaaaatattatgctgtacagttagtgtaaagtcaatgtttttcccgtgaattactattaaaaaagtataaaattttcatgccagatagttttgcaaagaagatctgcaatacgaatgatacaaaatcagaaaagtttatggtcatccttgaattatttaagtccagatcaaaaaacaatctggactttctattacagtctttcattatatttatatcccacaccccagattgtcaggatatattccggcgcatccggattcggctcaatctttttgcgtatcttcctgataaatgccatgatattactgtccgccatcatatattcatctgcccatacagcctgataaatctgctctttcgtaaacacttcccccttgttttggaaaaggaaataaagaatgtcaaattctttgggagttagatttacttcctgacctctgcataaaacccttctgctttttggattaatcatcaattccccggactgatattctctgtttccgtccgattcttccgacttttctaaaaacagggcgttttcctggctatgtaaaagcccttttaaaccctgtacaaattcctctgcctcctttatgtcctgatactctgtctgcactttttgtgaaatccactgaattaaatcacaaggaagggtaatataagtaatatcttttttcatggcgaccctccttaaattaattcatggtattgttttacatatcttcgcttgatccggtttgtcaggaacatatacactaaaacaactacaaaaaggaaaacaaaatatcctgccggaagtgttgttaatcctaaaatggttcctaatggaagcattgtaatgccggaaaatacaacaactccaagcgcggtaataattaccacactttttgacggcctgctttggataaaaggtatctttgctgtccttagcatttgcagaatcaatatctgtgaccacatagattcgagaaaccatcctgtctggaaaaccgtaatatatcttgcaatcattgccggatctgataaaccgtcaaaagtcacacctccgcaaactgaaggacacaagatgaaatacaggaataaaaatgtcaatatgtcaaacgcagaactgatcggtccaaaccagcgcataaatcttcccaatgtttttcccgaccactctctcggtttccggtaatcttccggatctacaagatcccatggaagaacgatgcaaagcgtatcatacagtaagttcaacaaaagaagctgtatggctgtcataggtaaaaaaggaaggaacgcactggcgcatacaatagaaaaaatatttccaaagttagaactggccgtaatacgaatgtattttgacatattgataaatgtctttctgccctctaaaattccttcttccagtacatttaagtctttgtccaacaaaacaacgtccgcagcatcctttgccgcatccaccgcagtatctacagaaattcccacatcagcttcgcagattgccggaacatcgtttagcccatctcctaaaaaacctactgtatgcccattttcccttaatacttgaataatttctactttttggttcggtgtcaactccgcaaatacttccccatactctacggctgtttgaagctgtgattcttcaagattttctatttcctgcccagttaaaatcctgctgcaatttacccctaccctctgacagacagataatgctacatcttttctgtctcccgtcaaaatctttgtcctgacctctaagtcccttaatttttttattgcttccttggcagattttttaggtgcatcaaagaatgtaagatagcctaataagatcatatggttttcgtccgcacaggtaatttctccggtagttatcatctcttttttcgctacggcaatgactttcattccatcttccagcatttctccgatgatttcatccatattcttttttgcatcgtcctgtatcggaagtatctgattctggtattctactctgtcgcagcattttagcaccgcgtctggttcaccctttaagactaactcctgccgtcctttctgatcctcgatcaagacactgacacactttctttcataatcaaaaggtatttcatctttcttttgataggtttccgtcagtgtttcgtaatagtcctgcttgtccggcatttcagaacattttaataccgcttcatcaatcggatttcggattcccgaatgataaaagctattcagatacgcatagttcaaaaccattttactgtcattccccagaatatccatataatattccagtatcatggtttcatttgtaattgtacctgtcttatcaatacacaaaacgtccatgctcccaaatccctgcatggaattcatattttttatcaaggttttctttttggacaactgcaagctcccttttgcaaggcaagccgtaataaccatcggcaacatttccggcatcagcccgactgccactgacaccgcaaacaaaaaagcttccagccaatttccttttgtaattccagaaacaacaaatacgatgggaactaatacaaacataaatttcagcatcactcttgcaatcgaattagcgcctttttcaaaaccatcagagcttcttattccctccatgtaggattttccatatagtgtattgcgccccgacgcaagaacaaccccttctccttttccactaatcacagtagttcccatgaataccagattgggatagtagattggcgatctctgaatttctccttcgtattttctgctgtttttttctacaatcgcgctttccccacttaccgcagcctgagaaagaaataggtcctgtgtattcgtcaaccgtaaatccgccggaatcctgctccctggcattacatacacacaatctcccggaactaattcttctgctgctacttctaaaagaactccccctctttttactttcacattcgtatgaatcaggcgctccatttcctcggatgcgtggtgtgatttcatctcctgaatcaaacgtatcccaccgctgacaaaaaccataatcagcaaaataaaagaagaatataaatttctttgttcatctgcctgcatccaatgattggtaagaaaagagattcctgctaaaaaaaataataccccggtaaatggattaaaaaaagccctccttatgcgataccatatagtatcttccctcttttccaacaagggattgtccctttttcttctttcttctacttgtttgatacttaacccctgctcagacgtctctaaaaatgtatatacttctgaaacttctttccacgctgcctgaatcaaaaattttttagattctgtctgttgttccatatctgcctccttttggattctattttaacatagtcaaaacaaaaagttattttccgacctatcaagcatctctttaagtttagaagtagcttgtatttctgaaagcatccccttataaaacgtctgtacgtgattatttcttattctctacaactcatgcgctcgttttgtatagagttattgccctattttagaaagtttaaagttgtactctcgaataaaagaaggagcgtcataatctatttcaaaagtatctttcttaaaagaatatattggttctccgatagctcccttaaaaagaaatgttcgggcaatccttatacaccctggggaatccaacttatctacgtcaaaaagtatttttgcctcgatacttttcggataattccctccacgaaaacgatgggtacgaatacattcttgaatatgctttatttgataaactgtataaggaaatctacttaaaatatcttttgcaagttcccctcctcgttccgcatgacaaatagatactaaaaaattatctatatctccttcctgctacaatatattttcaataaatagtataaccatttattgaacttggttcaatccagatttactgtttgagccacttcttttgaaaaagatataacggccaagccccattattctatttcatcgatatccgtctttctgatatactcaatagtttctgtttttagataaggttccattgatccggacaatgtgttcacgggttttattccgatccgtgtgggatacaaacttgaatggtatcctttacagtaccatcttgatttctgtctgccaaaagttcaaatgtctggaatttttctttcctccttttgattttcattgactttttattagtctacaagaaatttagatatctctaaacacaaaaaggacgaatcccttttgtgcttataagggttcgtccttaatagagtgtcaaatataaatattttatactatcttctattttcctgcattgttgatagctgcctgtgctgctgcaagtcttgcgatcggcacacggaacggtgagcaggatacataatctaaaccaatcttgtgacagaactctacggagcttggatctccaccgtgctctccacagattccaagatgcatcttgtcgtttgcaccctttcctaatttaatcgcagtttccatcagcttgccaacgcctgtctggtcaagttttgcaaacggatcgttctcgtagatcttagcgtcgtagtaagcgttgaggaacttaccagcgtcgtcacgggagaatccgaatgtcatctgagtcaggtcgtttgtaccgaagcagaagaagtcagcttcttttgcgatctcatctgctgtaagagcagctcttgggatctcgatcatagtaccaacttcgtattcaaggtcgattccagccgcttcaatctcagcgtcagcagtctcaacaacgaatttcttcacatatttcagctcttttacttctccaacaagcggaatcataatttccggtttgatgttccaatccggatgagctttctttacgttgatagcagcacggataaccgctcttgtctgcatcttcgcgatttccggataggtaactgcaagacggcatccacgatgccccatcatcgggttgaactcgtgcagactgtcgatgatcgctttaatctgctctacagtcttgccctgagcgtcagccagtttcttgatgtcctcttcctctgtcggaacgaactcatgcagcggcggatccaggaaacggatcgttaccgggttgccttccagagcttcgtaaagagcttcgaagtctccctgctgatatggaagaactttttcaagcgctttttctctttcttcttctgtctcagaacagatcatttcacggaatgcatcgattcttccttcaccgaagaacatatgctctgtacggcaaagcccgataccctctgcaccaagttcaactgctttcttagcatcttctggagtatctgcgtttgtacgaacttttaatgttctgtatttgtcagcccagttcataatacgctcaaactctccagcgattgtagcatctaccgtagggattactccgtcgtagatgttacctgttgtaccatcgatagagataaagtctccttcgtggaactcttttccaccaagtgtaaatttcttgtttgcttcatccatcacgatatcaccgcatccggatacacaacattcacccataccacgagcaacaacggctgcatgggatgtcataccaccacgaactgtcaggataccctgagcactcttcatacctgtaatatcttccggggatgtctcaagacgtacaagaacgactttctctcctctttccgcccattctacagcatcgtcagcggtgaacacaactttaccacatgcagctcccggagatgctccaagacctttccccatcggtgtagcagcttttagagccgctgcgtcgaactgcggatgaagtaatgtgtcaaggttacgaggatcgatcatagcaactgcttcttcttctgttctcataccctcatcaacgaggtcacatgcaatcttcaaagcagcctgagctgttctcttaccgttacgtgtctgaagcatgtacagtttaccgtgctctacagtaaactccatatcctgcatatctctgtagtgtgtctccagagtcttgcatacttctttgaactgtttgaacgcttccgggaatttgtcttccatctcggaaatgtgcatcggagtacgaacaccggcaacaacgtcttcaccctgtgcgtttgtaaggaactctccgaacagcccgttttctccagtagcagggtcacgggtaaatgcaacacctgttccacagtcgtctcccatgttaccaaatgccatcatctgtacgttgacagccgttccccaagaatacgggatatcgttatcacgacggtatacgttcgcacgtgggttgtcccaggaacggaatacagcctttacagcaccgataagctgctcttttgcgtcagacgggaagtctgttccgattttctctttgtattcagctttgaactgtgatgcgagagttttaagatcctcagccgtcagctcaacgtcaagcttcacgcctttttcttctttcatcttgtcaatgagttcttcaaaatatttctttccaacttccataacaacgtcagaatacatctggataaatcttctgtagcaatcccatgcccaacgtggatttccggaagcctctgccagagtttcaacaacttcttcattcagaccaaggttcaggatcgtatccatcatacctggcatggaagctctcgcaccggaacgtacagaaacgagaagcggattctctttgtctccgaatttctttcctgtgatttcttccagctttgtcattgcctccatgatctgagacataatctcgtcattgatctgtcttccgtcttcatagtactgtgtacaagcttctgtggtaactgtgaagccctgcggtacaggaagtccaaggcttgtcatctctgcaagattggcaccttttccgccaagaaggtttctcatggtagcgttaccttctttaaacatatacacccatttcgtagccatgtttcaaagtcctcctaatataatttttgtaatattgacacgcaaaacacgacttttcgatctgtttttgcaaaagccgtacgtttctgtctcaaatatcacgttctttcgcagtttcctgctggtaatattgtaaatgttttaacatagttcgtcaagaaatttatcgcatttctagccgatcttttcgataaatgccttgtatcctttgactgcttcatatacgtctgccttactggagatttcgtacaatgcatgcatacaaagaactgccacaccgctgtcgatgacttccattccatactgtgccatgatgtatgcaatcgttccgccgccgccgacatcaaccttaccaagctctgcgtactgatatccgacttctgcctcgtccatgactttgcgaatctgtgcaagatactctgcgtttgcgtcattggacccgttctttccgcggcttcctgtgaatttgttaaatacaagcccttttccgaagaatgcggaacttctcttttcaaatgcggatgcaaacatcggatcataagcagcgcttacatctgaggagagcatcttagaattctgaagggcacgtcttactttcaattcagattccccttctgtcatagcgatcagctctgctactgtattctcaaagaatttggagtgcatacctgttgcgcccacgcttccgatctcttccttatctacgaggatgcagcatgcagtacggctgatctgcggattatcgagcattgcaaataaagaagtaaacgcacacactctgtcatcctgtccataggatataatcatgcttctgtcaatcccacagtctcttgctttccccgccggaactatctcaagttcagcggacgtgaaatcttcttctccaatgccgtacgtctcggcaaggagacgaagcacacctgcctttactgcctctttttcttctttatccagtccctctgcttctgtgagcgggcggcttccgatgagaagatccaggttgtctccttctaccacctcagacgctttctgtgacatctgtttccctgccaggtgaactaataagtctgtgatcacaaataccggatcattctcgttttcaccgatattaacacgcacttttgttccgtctttctttacaatcactccatgcagagaaagcggggtggcaagccactgatatttcttaatccccccatagtagtgggtgtcaagatatgccatctcatctgtctcatagagcggattctgcttaatatcaattcttggagaatcaatatgcgctccaagaatgttcattccgttttccagaggttccttaccgatctggaagagaaggatcatttttcccatgaaagatgcataaactttgtccccttctttcagcgtttcgcccgctgctttataggcgcaaagcgaacgatatcctgcttcctccgcaaggcgctccgcaacttccacacattctctctctgtcttcccttcatccagacagcgtttgtaacgtgtactgatgtcctccatctctttcaattctgcctgtgtataggtcttccatacatttcttctgtccactgttttgttcctccttcagacatataaattggagcgcttggctccccattggcttcattatacctcatttttatcaaaagtcacagagattctttcattttctttacatattcttttacataaggcacacacttctctttgtactgtcggcaaagctttacgattgccgagccgacgatcacaccgtccgagaaacctgccatctttttggcctgctcctccgtagagatgccaaatcccaccgcacatggaatcttgtttattttttttaccagttcaaccatgccctgaatatctgttgtaatctctgaacgcactcccgtaactccaagagatgagacgcagtaaataaatccggcggcctcttttgctatgttacagattctctcttttgatgtaggagcgatcagagaaataaagtcaatcccgtgcattttacagacatggtcaaactcttctttctcttcaaagggaacatcaggcaggatcaacccatccatacccacttccgcagatgtcctgataaaccgctgtgttccgtaagaaaataccacattggcgtaagtcataaatacaagtggaattctcgtccgtttcctcagccttctcaccatcagaaagatgtcatccgtagtaacacctccggacagagcccgtaaattggcttcctgaatgaccgggccttccgctgtaggatcagaaaacgggatcccaagttctataagatccgctcctgcctcttccatggcaagaaccagctcctccgtcacatcaagcgatggatcgccgcaggtgataaatgggataaatgcctttcccttttcaaacgcatgtctgatattactcataaagatcctcccctctgtatctcgcaatagctgcacagtctttatcccctctcccggacagattgatcacaagacattcttcttttttcatctctttcgcaagtttcatggcatatgccacggcatgagcgctttcaatggccggaatgatcccttccgttcttgacagatattcaaatgcgtttactgcctcgtcatccgttaccgccacatattctgcacgtcctttatcgtacagatccgcatgttccgggccgatccccggataatccaatccggctgaaatcgaataaaccggcgcaatctgaccgtattcatcctggcaaaaatacgatttcattccatgaaaaatgccgggttttccggtggcaatggttgccgctgtctcttttgtacttatccctcttcctgccgcttcgcatccgaacagccggacgtctttatcttcaatgaaatgatagaacgctccgatggcattggatcctccgcctacgcaggccagaacggcatccggcagtttcccctccatctccatcatctgctctttgatctctttggagatcactgactgaaaatcccgtacaatcgttgggaacgggtgtggtcccatcacagatcccagaacatagtgagtgtcgtcaatacgctttgtccattccctcatagtttcggataccgcgtcttttaaagttgccgttcctgtcgtaaccggatgaacctttgctcccagaagcttcatcttataaacattgagtgcctgtcgcttcatatcctcttctcccatgaatatttcgcactccattcccatcagagcggcaactgttgccgttgctactccgtgctgccctgctcctgtctcggcaatgaccctcgtcttacccatcttctttgcaagcagcacctgtcccaggacattgttaatcttatgtgctcccgtgtggttcagatcctcccgtttcagataaatcctggctcctcccaaatcttctgtcatatgttttgcaaaataaagacgggatggtcttccggcatactcgttcagaaggtctgtcagttcccgttgaaactccgcttcccctttgtagtaataatacgcttcttccaattcaatcaccgcattcatcagggtttccggaatatactgccctccatgggcaccaaatcttccttttgacatctctgtttcttcctttcttctatcttctcttattcggtcagcgtccgaagcatccgaactgccgccaaaattttctttccatctttttgcccgtccgtctccacgctgctgtttacatcaagcgcaaacggtgaaaaacgtcgaaggacttcttccatattgtgcgtcccgatccctcctgccataaaatacggcctcggaatatcctcaagcagattccagtcaaaggtctgtcctgtaccgccctctccacaatcaaataataagtaatcagccggagacaacaccgctgagcgtacatcctctttgcttctgacagaaactgccttaatgacaggcacctgtgccttgctttgaatcgtatggatgatttcaccattttcctgtccatgaagctgaaccatccggattccggattctcttacaattctcaggataacatctgtcttctcgttgacgaagactccgattgggacaatctccggattcaacatgtccaccagtatgttaagctgctctgccccgatgcttcttctgcttcccgaaacattgaaaataaatccacagtaatccggctccgccacattgacagatattacatcctcgattcgtttcaggccgcagattttgatctttgttttcatctatgtttccctctcagcacatccagtgctttccttttatctgttgcccgcattaacgtctccccaatcagtatcgcgtctgttccattttcccgcagaagccggacgtcctcagggttgcggataccgctttcagacacatacactgtctccggcggcaccagatctctcatccggatactggtttccagatccacctgaaaggtgtgcagatcccggttattcactccgatcacccttgctcgacactgctttgccatctccacctcttcttctgaatgtgcctccaccagagccgaaagaccgagctgctccgccagttccagatattccatcaactcttcttcgcgaagaatagcgcagatcagaaggacggcatccgcccgcatggctttcgcctcataaatcatatatggatcgacggtgaaatcttttctcaggacagggagctttactttccctgcgatctcttccaaaaacacatcacttccctggaaataaaagggttctgtcaaacacgaaattgccgatgccccggctttttcatactcccttgcaatatccagatacggaaatgtttccaaaatgacccctttggagggagaggccttcttcacttcacagataaaggaaagtcctggctgcttcaggtttttctcaaacaaaaaaggctctttttctccggcccgttccgcaattctttctttcagaagtaagacagggacttcccgcttcctatgctctatccgttcttttgtctttgccgcaatttcacttagtatcgtacccatagagacctcctaccgctctttttccaggcctccggattcctggataaattcatccagcttctttctggctgccccactgtcaagcagctcctgagccattctgacgccttctttcattgtcggaactttccctgacaggtaaagagcagctccggaatttagcgcaacggcgtctctttttgcccctttctttccatttagaatctccatggtaatctttgcgttctcccgcggcgtaccgccggtcaaatcttcttttcggcagcgaacaaatccaaagtcttccggacagatttcatatgtccggtaagaaccatccctgatctcgcagactttcgtcggagcgctcatggaaatctcatccagttgatccatgccgtagacgaccatccccctcttcactcccagattgttcatcacccttgccaacggttctaccaaagtctcctcgtaaactcccatcagctccatattggctcccgccgggttggacagcggtcccagaatattaaataccgtacggattccaagttctttccggatgggtgccacatatttcatcgcaatgtgatagttctgagcgaacagaaaacagattccgatctttttcagcatcgccgcacttttctccggagagacgttgattttcacccccagcgcttccagtacgtctgccgcgccgcttttgctggaagcggcgcggttgccgtgtttcgccaccggtacgccccctgccgcaatgaccagggcggaagtggtggagatattaaaggaatttgctccatcccctcccgtccccacaatctccagtacatccatctcatgcagcagacggatacagtgatccctcattcctttcgccgaccctgtgatctcttcgatggtttctcctttcagggaaagcgccgtcagataggaactcatctgcaccggacttgctttcccgtccatgatctcattcatcacttccagcgcctcctgcgctgtcagatcatttcgctgtgccagttttaaaattgcttctttaatcatgtctgtaaccctccacaaaattctgaattatcttttccccttctggtgtaagtacggattccgggtgaaactgcagcccgtaaaccggatattttttatgttccactgccatagcttcctggtcgtcggctcttgccgtaactctcagaatgtatggcagcgtctcctctttctggtctgccggaaattttccgttataaaaccaacaaaaaaatccctgatacagacaacttgcatatatctgtatcaaggacgatatctacttaccgcggtgccaccttgattcacggaaatatcccgtgcgctttgcgaaatactaacatatctccggcaactgacgtatgccctacgtcgcagagtactgggcaggaatatctgcttttgactgcgccctctgtggtccatttggctgactgcgttccatccggctctcaccttcccggactctctgtgggtgcacgacaactttgatctccacttcaacggtttatctggctaaattcaatttttatttattatatgatcaattcagggatctgtcaatacttttttcaaggttttccatctccgtcagaatctctttctgacgctcatcaaagaggagccctttattgtatttgtaataatacgggcaatcattctcccgcaagaatcggatactgtcaccgtttgtgtgaagctcggccagaaaagccgccatctcctgactctccccgaaggcttcctccagaaagcaaaacgtatgttccaacgcatccatcgttttgtcaataacattctcccgctgctttgtctgtagggaaaatcgttccttgataaaagcgaactccgcctcccagccgctatccccggccttctctgttctcagttgccactgacggctataggattccagttcttccagaactgccctctccagtttctctgcttctcctgataaaagatccgcacgcttctttgcaagatagtcttcccgtctttctctgatgactgcctccagatccttcttttccttgcagtttttcagtgcatcatagagacgcgcagtcttttcatcctccacacaataggcacggaaaaactcgcagagctttccacttaacatcccgacgatactgaaccgctcgtcaaaggaagcaaaccgaagtttttccagcgtctccttactgtagacgccctgcacaatcttttcgagcccgtaatcctttttatatttttcataaagttccatgtagttggcaaactcctttgccacctcccaattttgcaaatactggtgtaccacttcccggtccgccttttttcctaacatacggtagactttcagaagctcagataagtcctcccaccccctggcagtcacaaactgtttcccgtctaccgtattttccacccggtaaaaatgagattttcggagttccaggtaggccagaatcaccgggtcaatgcctgcttcgtaagcatattcccgccacacattatagttttcctcgatatcgatcctctttaaacggtccaatgttacgatatcaaactcccggacagatttattgtactccggcggattgcctgccgccacgatgatccatccttccggaaccttttgatttccgaacatcttgcactgtaaaaactgcagcatcgtcggcgccagcgtctccgatacacagttgatctcatccagaaaaagaattccttcctttaatccggtccgctccatcttctcgtaaacagaagcgataatctcgctcatcgtgtactccgtgaccgaacaggttcgatcctggtaaaccttctctctgataaaagggagacccacagcgctctgtctggtatgatgggtgatggtgtaggagaccagagcgatcccgcattttcttgcgatctgctccataatctgtgtcttcccgataccaggaggccccatgagaagaatcggcctctgccggaaagatggtatcagataatgcccgtcctcgtctttttgcaggtaagcctcaatggaatccagaatctcctgctttgctcgtttgatatgcatccttatgcttcctcgctttccgtaaatattgcctcatccaaaatgagccggatggcccacgccggggttcgtatgtctcttctgccgtcatcaataaagacaaaggctgtgtcatacgccggcatctgtgacggataagtaccgtatccgtctgtaaaatagatcacgccccgcaggtttgtaaattctcctttttcgatcagactgtcaatataggcaaaggacggacggaagtctgttcctccgcctccgtaaaatttcagatgctccatatattctttccagtccttccgcttcgtaatacggacgtcctcccggactttctcgtcacattgcaggatgcggatgtgaactttccggaagaaactttcattctcacttaatacatcgtaggtctcctccagaaacttccggaccagttctccggaacaggacatggaggtatccaccacaatgacaaattcttcaatctttttgacctcttttgtctcttggggctcgatcagcggcatattgccgtacatggataatccgtaagtgtaaaaggtgtaatcaaagctgtcgtcatccaccccgatctcctctttccacacagaaaacttccgcaaaaattcccgatagtcataccgctttttgttggcaatccgcagctcgtccatcagatccccggatgtttcatcctcctcttgtgcgaaggtgtcaagatccagctccatctgttcactgatctgctgccagttgttctgtgtttcattgggctgtcttctttgctcgtccggttttggccagtagagatggctgtctgtggcaaattcctcctccatcttttgcctcctcgtctcgcttagtccccatgccgtcagacagtggtagatcttttgggcactcaagacgtccgtcttttgttttagctgtcggtatgtctccttgcggagccaggaagacgcctttcggacacaggggtgggaaaggctgtcgatcaccgactccaccgcaatattacaggccagatcccagaacacttcattgcgcttcccttttaaaaacaggtggccgaacagacagtgcagtactacatggaggtacgcccggttcacccctcttcgatccgtccggtacgtaccgccaagccatccgggatggaaatacagcatctgcccatctgttccgatagaaccaatctccccgtccatctgaaaccggagactggaaagcgccacatcaaggtaacgcatcttcaaatacagctcatttctggctatctttaaaatctcctgtccgagcagctccagacgccgaagctgctcttcttcctgatttttctccatctttttctccttttatagctcaaacgtctttttgcctgccgtcccccggcgttttgaaagaagcagggcggccgcctccgcctgtcctatctcctgggctttatcaagtgcctcctccagactctctccctcccagattcgatgctccaggagaaaaagaaccgtctccatatcgtcccggacaaaaagcaaatctgccgtgtccccagcacattttctcagaaaagaagtatactcctccctcgcctgttctgacaaccggtagggaaaacaaagccgtgccaatgcgatttcaatcaatgtccgcacgctctcccttgcctttgctttggcaaacagggaatcgtactcctcatagtcgatctccttgtgatagacgcactgccgataatccccacccgccccatggtagtgggtttccacgatccgtgccggagtattctccaccgcctcttcatagtgttccgggaaaatgagccgtgccacttccacgttgtccccgccttcgtaagaaatccgtacctccagctcaaagcgctgttcctccagaaactgtctgagacaagtccgccttgtctgtctgcatgctatatccaatctggcaagctggcatccggtaaacgctccgccctcgatgctttggaggctgtctgtaaaagacagacgtttcaaccgggagcaccggtaaaaggcataccgcccgatctcccatacctgagacggcagatggacctcctctacaagctccccgcaaagccgtctacgttcttcgggcatatttccctcttcttccggcaaaaaaatgaaaaggctgcgcttctcatctgtctttgcaaagccatagtccccgatcttcgtcactggaacaccatgaatctgtgccggaagataaatctccggacttacaccgtagcatccgaaaactgtggccgtccgggcaccgcccgactgtctgctttcttctatttgataatggatttccggatacatgtcgtccctccttttttaagtttcaccttatcagcactatgctcatcaccggaagtaccaaaaggcaccttccgggatcgcaggcatccgacaaggtttctgacaagcctgtatttcggcttaccgccaaaacaaataacggccggaagacaactgctcccggcctcatttttagtattcaaacttcttttcaaaatatgctttgagatcttcgatcttgactctttcctgctccatggtgtcacgatcacggacagtcactgctccatcctcctcggactcaaaatcgtaagtcacgcagaacggggttccgatctcatcctgacgacggtaacgcttgccaatgtttccacggtcgtcgtattcacagttgtaatatttactcagttcggtatagatcttttctgcgccttcgtttaacttcttggagagcggaagaacaccgatcttcaccggagcgagggccggatggaaatgaaggacagtacgcacgtcgccgccttctaattcttcctcatcgtaagccgcacagaggaacgcaagaaccacgcggtccgctcccagagacggctcaatgacatatgggaggtatttctctttcttctcatcgtcaaagtaggtcagatcctgcttggatacgtcctgatgctgtctcaaatcgtaatccgtacgatccgcgattccccacagttcgccccatccgaatgggaataagaattccaggtcagtcgtcgcacggctgtaatgggaaagctcttctttctcatggtcacgggcacgcagctcgtcctctgtcattccaagacctctcagccagttatagcagaaatctttccagtaccggaaccactccagatctgttcccggctcacagaagaactccaactccatctgctcgaactctcttgtacggaatgtaaaatttccaggtgtgatctcgttacggaatgactttccgatctgaccgataccaaacgggatcttctttctggaagtccgctgaacattcttaaagtttacaaagatgccctgggctgtctccggacgaagatatacaacattctttgcgtcctctgttacgccctggaatgtcttaaacatcagattaaattcccggatctccgtgaaattatgcttgccgcagctcggacacgggatctgatgctcattgatgaattgcatcatcttctcatgggaccaggcgtctacgctttccttgatctcaatcccatgctctttcgcataatcttcaatcagtttatctgcacggaaacgctccttacactctttacagtccatcagagggtcgctgaagttcccaagatgtccggaagcgacccatgtctgcggattcatcaggattgcgcagtctacaccgacattgtaaggattttcctgaataaatttcttccaccatgctttttttacgttatttttcagttccacaccgagatttccataatcccatgtattggcaagacctccatagatttcagatcccggatatacaaaccccctggttttggcaagagctacgattttttccattgtcttttctaccatcgtcttttacctcacattcttctaaaattgttaccattatacggtaattttcccccttttgcaagcagtacactccatttaaaggaattccagcatctccagagaccggaacgtatggcctatgtatacatccacgcatctcttcgccgactgttttaactcctccagtactttctcagtgacggtaaaggtgtagagcttctctaccggagtggccacaataaaagcaagcgcatagactgtggactgccccactctccgggcatcggacgctttcgacacacaatcccggcaaaggagccctcctttcgcggcactgaaccagtacggctcaccctgctttccacatccgacacaggaaaagacctgtggggcctccccttcaagacagatcatcttcagctcgaaaatgcatcggatcagcgaaagagaaatgcttctcttgacgacaatccgcatcgtctggtagagaagctttaaaatttccgtctcgtcgttgttttctctcgtaacatattctgcaaattccaggaaataaaacccatatgatacagcctcaatatctgtccttagctccccaaaataattctggatttccgcctgctgcattgtataggaggagcgtccctcgtacaacgtaaacgtgccgaacagaaacgggcttgtcgttccgacaagcatactgttcggccgccttgcgccttttgcaaaagcggagatcttcccccgctcacgggagaggatcaccactcttttatcgtattctccaatcggaagcgctgacagaatcattcctgtcacggtaatcgtctggctcactttcttcatccttccggctttcgttctgataccggttcatcacggcttcacaccgtgccatccctctgtaggtcagataatcttccacctttccggtttttacaaaccgttcccagtagtcttctttcatcggatcacctcttcatcttttggaataaacttaggttctccgattttccctttgttattcttcttcccggtatccaaaatttctcatcagaaattcactgtctctccagtcttttttgaccttcacccacagctttaaatttacctggcagtcaagcatccgctcgatctcaaaccgtgctgtactgccgatcttcttcagcatactgccctgctttccgatgatgatccctttatgggaatcccgctcgcagatgatagtcgcgtcaatgtctgcaatcgtccccttttgacctttcctgaatttcatccggtcaatcaccaccgcgatcccatgcgggatctcctcattgaggctgtggagtgctttctcccggatcagctcagagacgatctgacgttccggctggtccgtcaccgtgtcctcgtcgtaaaaccgcgggccgtacgggaggtactgtaaaatgactctcaccagctcgtctgtgttctccccggttcttgcacaaaccggaacaatctcggcaaaatgataaatatctttatattttgcgatacacggaagcagctcttcccgtttcacctgatctactttattcatcacaagaatcaccggcgtgcggaccttctcaagctgctgtgcgatgtgctgctcacccgctccgataaaggtagacggctccacaagccaaagcaccacgtctacctcgtttaacgtacgctccgccacattgaccatataggcgccaagcttatttttggccttatgaattcccggtgtatccacaaagacgatctgtccctcctcagtcgtaagtaccgtctggatccggtttctcgtcgtctgcggtttattcgatgtgatggcgattttctgcccgatcatacggttcatcaaagtggatttccctacgttcggacggccgatcagcgttacaaatcctgatttatactgtttgttttctatcaaaccatgttcctctttccttcgtaagcatgttttttcacatgtctgtttcctttgtccgagtctgcttctaaaagagcgcctttatctcagtgaatacttcccgatcctgctcaatcttctcctcgtttccgatcacgcagacctgatcttcccgtaatacctgctctacaatcccggccagattgcggatatcctgctgtgtagcgtggagaacctctcttctctcctgttccatcatctcttttgtcacatggttcatatagagattcatggatcggtctcccttgacagccggggtcatcggctgatccatgttgctgattgtaccgatgatgaatttcgtcatatcccggtcgctgaccgcaaaatttctcagataatccgttacgccctgataaatatccaacgtatttttgagatgcggatcccggtaggatgcaaaatacccctctcccaatctgttgaagctgctcatacagccgtaagctccgcccttgacacggatgttctgccaaagatattcatatcccataatcactttcagaatctgaagcgctccatggtattccattcccgcatcaataaagtttcctgccattgccacatactgtactttagacgcagtctggaagccctcgtttttctttgtacaggtgagaagaaagccgccctcttttaccttttctttccacaggcgcccagaaaatgccgcaattccggcaagaaccgcgtcaaagctttcttttgctccagtatagcttacgatcatccactctttccggaagatcttcttacagagctctgtcaggatgctcacgagccttcccttctcctcatcaaaatgatcggcaatccgactgacagtctcgtagtactcgataccgtttgtcatatccttaaaacgggccgccggagaatgataggacatggcccgcagcacggcggaactatgtcccgcggagaggaatttcatctggagtctcgatttgagcatctcaagaatctccttcaaccgcttctcatcgcttaagacggaccgcatcagaatctcttccatcatggaaagagcgaatggaagctctgcgtagagtgccttcgccttgatctcaaaggtcggacgaaactccttttcctttaccttggtaacgtcggtatacatctccagggacgtctcaatccccccggtacgccggttaatctcatggaagagcttgccgtactcgtagtgttctgtatcgatgataccaagcactgcctgcaggagtcctgcatacgggatctcttcttccgtcagtgtcctgaggtcaaagatcatcgtcagatatccgatgccgttcgtctcaatcggatgacagatacaagtgacgtcgcctgcttttctctcctcgttatagaccggagctgcctcctcagagatatcgctgactttcagaaccggaatcttctccagaatctccggcggggtcggctcctcctggtacgcgcgcagctcttttgtatcctttacaagcttttccacttcttcccggctcaggcttcttttatagtcctgaagccttttctgaatcttccggtctgcctccgccgccatccctttcttcggacagatcatcacaatagaagcgtgggtattgtcaagcagatactcctgaatcagatcttcataatatgatgttccaatctgctcttttaaaaacgcaaacgtgtcaagcgcatcgaggtgaagaaacggtctcttctcatcataaagccaactgtcgagcatctgaagaccatacatcagtcccttcggatagcttccaaaatcagcttcccggtaacggaactcatggtaatgaatacccgcagccagcgcatccggatcgatcccttcttttacaagccttgtaagggtagactcaatcacctgaataaaggcatctttttgggactcctccgcatttttggcaatgacggagaaaataggctggcatattccattttcgtaagagccgagaatatcgtgtccgattccggcgtctgtcaatgctttcttaagcggcgccccaggggcggacaataacgcataatccagaatggaaaatgccagatacagcttctcatcgaggctcgttcccacaaccttattataagaaagataggtgttcatctcctctgtctccgtattggagatggagtaataccgcttccattccaccggatgttcaaatggcttttgcatcttgatctcagagtcaatccaagcacagtcaaaccggctcagataatgctcatccagccaggtaagctttgcttccatatccatatcgccgtacagataaagataactgttggagggatgataatacttgcgatgaaaatccaaaaagtcctcataagtcagggacggaatctcatccggatccccgccggactcgttagagtaagacgtatccggaaacagggaattcaaaatcatccggtctaacacaccgtccggcgaggagaatgctcctttcatttcattatatacgacgccattgtatttcagttctccgtctgcatcctccagttcgtaactccatccctcctgacggaatgtcttatcattttcataaatattcgggtaaaataccgcatccatatagacgtgcatcaggttctgaaaatcctggtcattgcaacttgcaaccgggtataccgtcttatccggatatgtcatcgcatttaagaacgtattcagcgaccctttcaccagctccacgaacggatctttggccggaaattctcttgacccgcaaagcaccgaatgttccaggatatgtggaagtcctgtactgtcctgcggaggcgttctaaaccccacggaaaaaactttattttcatcctcattctcaatcaaaacaatccttgccccactcttcttatggcggagcagatatcccttggactggatcccctttaattcctgctcctgcatgagctcgtatgcctgtaatctctttgtctccatttccaacctcctcattgtgacatcttgtctctgctctatagtataccatgatttccctgcccgtaaaacacgagaaccggaaatcctcttgttctttccctactccgtctttccattgctcttttcaatcatattgcggatatcctgcatttcctggtcaagctgggagatgatcgtagcgcaccgtttcagttttctctggatctctccctcatcatcgatctcttttttgtatcggaggcgatgatccacactggcccagaaatccatggcgatcgtccggaactgcacttctactttcatataccgctttccatcagccagaaaaatcggaatctccaaaatcagatggaggcttcggtagccgttctcctttggattttgtatgtagtctttcgtcctgagcagtcggatatcgtcttgtcctgtcaaaagctcagccagcttatagatatcctcctggaacgcacatactacccgaattcctgccacatcaaataaatgctcttcaatattttccagcgtcggctccaatccctttcttttcagcttttccataatgctggccggagacttcagcctcgtttctatggattcaaaaggattccggtcgtaattcagcgaaaactcggcgtccaatacattaagcttcgtctccacttccataatcgcgcatttatattgattcatcaatgctgtaaattccacgctgtttgccatatcacagctatctgtacgctgtgtatagatctccttcaagttttctttcattgactacacctcttttatccaatatcgcatgattaatcctcagtatagtatagcaaaggcatgggggaaactccaatgaaaaatctataaacaatttctgtcctaaagttcaatttgtgctattataagaaagagaaatctttttatcggggaggaatgttatgatgacagaacatacacgtacatggctcaagaccggacttgtctccggattgatttatcttatttcgatcacaccacgtcttctgggaagagccagacgaatgccaggaaaattttatgctcaccggggacttcacaatctctccgaaggtgtcccggagaattccatggctgctttccgacgtgcggcagagcatggctacggcattgagctggatgtccagcttacccgggacggacaggttatcgtagcccatgattatgacctgaagcgcatctgcggtatcgaaaaggaaatcgattctctcacttataaggaactttcccatttcccgattctcgggacggaagaacgaattccactcttagaggatgtgctgaaactggtaaacgggcaggtgccgctcatcgtagagatcaaatataagcatcttggcagcaccatctgcaaaaaaacagcagaacttctggatcattacagcggctccttctgtattgagtccttccatccggcagctctgatctggtttcgaaaataccgcccatatgtgtgccgtggacagcttggaatgaatttccataaggacgacggtcgggtgcacccggtttactatttcccgcgccacctgctgacaaactttctaacaaagccggactttatcgcctatgaccatcacgcaagaggcgcgttatctctgacactttgccgggtcattttcggcacgccatgctttgcatggactgtaaaatccagccgggaactctatgcgtgcgagcaggcctttgattattttatctttgagggtttccttccagaagaccaggaacggtcctgaattttttataatttaagcttgatacttggaaagagggggcataaagccccctcttctgatgtggcggacagaatccgccgaactgatttttatttgtcgtagatggttttaatctcaagaaattcttcgtatccttccactccgccttctcttccgagtccggattgtttatatcctccaaacggagaagtaggatcccactgtccttcattgacataaacagttcctgtcttcatctggcgtgcaactttatttgcctcttcttccggcccgtatacagcgcccgccagtccgtaaatgctgtcgtttgcaatttttaccgcttcctcttccgtctcatacggaatgacaacaagtaccggtccgaaaatttcttcctgagcaatcctcatatccggttttacatcgctgaagatgaccggttttatataatagctgccgttatcctccggaacttctccagataccattcttgccccttcctgaagtccgagttcaatataccctttcacacggtcaaactgcttcttcgatgacagtggtccctgtgtcacagccggatcttctgccggcccatattgatactcttccaactgctttttgatgatttcctctgcttttgcaagtccgttctttggtacaagaagcctggttaatgcattgcatgtctgtcccgcattcggcacaacggtttccaaaacgccatgaataccgttctcccagtctccaccgtccagaaggatcgctgctgattttccacccagttccaaagcgatcttcttaatatttccaagcgccattctggccacttcccgacctgctcctgtagatccggtaaaagaaatcatatccacatcttcatgggtagcaagcgcgtttccaacttctccaccccgtcctgtcacaagattgaagacgccggccggatatcctgctttatcaatttcttcggcaagaatatatgcggtcagtggtgtaaactgacttggttttaatacgacacagtttcctgccagaagagccggtactaccttcttttcaatctgttccaatgggaagttccatggagtcagacctccgacaactccgaccggctcccttcttacgacggaagtgaggcgtctctgctcatacgggaattcggacgctgtctggatgtagtgctttgcctccagaataaacggatctgtatgcacttcagcggaaactttgtacggggagccaagttcttttgtgatggtctcgatcagttcctggcgtctgctctccagtccttccaccacttttttcatcagcgccactctttcctccagaggagtatactgccatgtttcaaaagctgctctcgccgccttgaccgctttatccacatcttctttgtttcctcttggtacttttgcgatgatctcatgtgttgccggattctcgatctcaatccactcgtcgtgaacagaatctacccattctccattaatgtacagtttacggatttccatactgctcttacctctctttctgaactgtaacaaactgcttaccctctcttctatcgaagtgtttcaaacttcatagcttccgaaagatatgtcttctcttcctcatttaattccatacgtggtcttctgacatatcctccatttaatcctttcttgctcaggccgtatttcaatgcctgcaccggttttgggaacgattccagtacatttaaagcaggcaggatctctttgtaaatttcctttcctttcttcaggtcttcttccacataaacagcctggtaaagatccacgcactgtttcggagctacgtttgccaacatacagatccatccacatgcaccgtccgcaaaactttcgtatgcaagattatcgcatccgcagaatacagaaactttctccggggcgtcgatcagtacttctgtcagtttttgcatactgccgctggattctttcacaatcgcggtatatgggagcgccatgatctgccggaaagcatcctgtccgatctcgatgcctgcggagccaggattgttgtacgcgacaatcgggaactgtgtctgctcttcaatatagcggtaatgctccacaatttcgtcctgtgccggatgacaatagaaagatggcagcaccatcgctgcatgtgcaccacattccttgatattgttgaccagcttcaccacatcctccggccgctctctggacgcacctacgatcacgctcacacggtcttttacatacggcacaatctctttgacataagccatatgctcctcgtctgaaatactctggtattctcctgtcgctcccagaatacagactccctgcacaccttgttcaatcagccaatccagatttttctttgctgactcaacatcaaacgtcccatcctcgtaaaacggtgtgactactacggcataaataccttgaaattgtttgttcattgcttacctccttgattgattctctttctctataaattccagcctattcttacgcaaaacggtcaaatcgaagcggacttaaatccatgaacgaagtttcccccgcaatcatatccgccatcacttttccagtgattggggaaagtccgatcccgtctccttcgtgtccggccgcaatatagaaaccatccaccggtgtatctgacacgattggcatatgatccggcgtgtacggccgaagtccgctgtacgaccggattaccttaatatccgcaatcaccgggaagaaccggatggcccgttctgccatagctttcattacctcaatactgcttctggtatcttctcctgcaaaggttctggaagaaccgatgaggaaattgttggaggccgttggttcaaagacaaaagcgactccatatttctccacccgttctgataccggacgctcatagccgtcgctctggaatttggtagacatataaccaaattcatgtactttccttctcgccacctggaaagtctgctccgagacaaggatctgtccctgacgggcttgaatcggaatggtaagcccaaccatctgtccgattaccggggaccatactccgcaggcatccacaatatttttagccgcaatctccccgttctgtgtatcaaggataaacgcgtccccatcccgtcggatgcctctgacacgattatgcaaagaaagcaccgcaccctttttttccgcgcccagcgccataccatacgtcaggccgattggatagacagatccatccgacatcgtctccagtcctccgtagacgtcttttgcaagatacggttcatcgtcctgcacttctttttgatccatcatccgcatcgggattccgcattttttcatagattcacagaactcggacgccatctggaattcttcctctgtctctgtcaggaagagacttcctctttgtttccattcaaaatcataatccagctctttgctcagtccctcgaacatatcctgacttgcctttgcaaacagagcgtcaaatcccggttgcttatcgcagacaaggacattcccatcacttcggctgcttgtagactgggcgatgtctccggcgtcgatcaggacgacagaggctcccttttttgcgttaaagtacgccacagatgaaccgatggcgccggccccgataaccgctacatcatatgctttgcccatgtgtttatccctcctgatcttctccatcttctgctagttctccaaatgtcacagggcgtaccggcggccggtccgtgcttccctggatttcactcatcttctttcctgtctcttccgcaataatccggctgaccagcttgccgcatgttcttccctggcaaagccccattccggcgcggactctccttttgacttctgtcacggtagttgcatggtattttcgaatcgccttcctgatctctcccgccgtaatctcttcacagcggcatacaatcacgtcatcgtccagcgggccttctggttccaccgcacggaatccctcatgttcttccggaagcttcaatcttctcatcgtccggacagtgtctgcgtattcctttggaatcgccagtgtgacaaccggtgtgtgatcgtttttcttcggattcatcactttgacgacatgacccttgcagacatactctcccccacgggaaagggcgtccacttctgctcccggctccggaagtgggtcgtattcgaacggaaagcttactgtagcctccgtttcggaataacttttatccacaaggaaaatagccagtcccggacaggctgccacgcacatgccgcatccgatacatgtttctttgtccactttcggcgtgttggtaatcggttccccgatgtgaatcgcatggaacggacaggcagattcacaaggattacacgggatctgctgtacacattctacgactgccaccggtccttttaaaaagcgctcttcgtccggccaaccatttgcctctttgatctcttccattgacggaaacccgtcataaatgattcctgctgccatttttcaaacccccttctcgatgatccgttcctttgccgccattcttcggtcgccgaacggcccttgtctcagggaatccagtctttctctgatcccggtctttatcttttctgcttcttccttactcagatatccaagcgcttccgcagcagccgcagcagcgagccttccttcatccatggctgtgcttgcctcctctacccctgccgtatcacctgctacataaattcccggtacacttgtctccatatccatattatgaagcggcatccatccgcccatttccggaatgaaatcatgctgtacgcctgccatctgcgcgagttcggaaagtggccgcaagccgaccgccacgcagataacatccacatcggtctccatctctgttccttttacaatctgtccgttctcaaatttggcgatcaccgctttttccacatgatctgtcccttttgcctccgcaatcgtactgccaagataaaacgggattccggcacgtcgaatcttcgccgcatggacaccataggcgccgatctttggcatcccctccacaattccgacgacatccgcccctgcctgaagaagctggtacgcaacaatcacgccgacatttccagatccgatcatcagaattcgtttcccaggaagcactctctgtacattcgccattgtctgcgctgctccggctcccatcacacctgggagcgtccagccaggaaatctgagtggattttccgcgcctccggtacacagaagaagcttctgtgcctccacaatttctgtctttccatctcttaaaatcgctgctcttttatccggaaaaattccgatacaggcactattcagccagaaatcgattcccagttcctctgtttccatcaaaagctgctttccgatatcaatccctcgcacgcccgcacggtgcgccctggagccaaaaaatttatgtaactgtttaaaaagctgacctcccgcacgtctgttctcatctacaagaagcacgtcacagccatcccttttcgcttcgattgccgcggcaagccccgcaggacctccgccaatgattactacctctctcttcattctttcgtgcctctctttccgaatccctgctgtgtctcgattaccattccttcttccaccggagtgatacaggtacggacgtttggcttcccattgactgtcatcacacagtctgtacattgtcctattccacagaatactccccgtggctcatgcttctttgtcgtatatctatgaatatggattccattcgccattaacgctgccgcaatcgtttctccgctttttgcccgaagtttctttccatccacgataatctccacgtagtcatcctgactaagttctcccaaaatcggatggtgtaatactctcattgtatctgtttccatcttgttgtctcctttcctcctttatgccagttgatatccttcctgaaaaatatcgtccggatccagcaggaacgtatgaatccctgtcacccaggctcttccagtcacctttggaatcacggccggacgtccggcaacctccgcgtcgtccaggtattcacaccggaactgtcctccgatgatactttggtgaatgaagctctctccttttttgatctgcccctttgaggccaggacagagagctttgcggacgttcctgttccacacggcgaacggtcgattgctcccggaggaataatcaccgcatttttgattgctccatcttcctggtccgtcggctcataaaattcaatatgagtcacatggttttcaaacgggatcgtcggatgatgaacctcaatctgttcgttaatccgttgtttcagataatttccggcctcaatcagaagcatggaactctgtggattgatatgaagtcctaccgatgccgaaggaagaatcgcgtagatattgccgccatatgcgatgtcagctcttaaggttccgtattttcctgtcctgatctccgcgtcctgtaccattacaaatgccggagcattgacaaacgtcacgctgacagccgaacagtttctgacttctatctgaagcttcaccagccctgcggcggtgtccaatgtcacataggtgtgcggctcctgcacctctaccataccagcttccacaagagccgttcctacgccgatcgtatcgtgtccgcacatcggcatccatccgcctacctcaaaatagagaactccaaaatccgcctccggattgcagggctccataatcagtgtgccagacataacctcattcccccttggctcatatgtcagcagtttccgaagccagtcgccctttgtggacatatagtgcagtttctcctgcatcgtctcacccggtatatgaggaattcctccaatcacatttcgcgtcggttccccacaggtatgtgtgtctatcgtgtgaaatgtttttctgatattcaccccagtttcctcctctttctgcttttcgtacgtatttgtgtttttagaccgcgttctactttatagatatattatatcataaatttcattttcgtcaatctttttattcatatttatgaaataatttatttatttgtgaattaaatatcgaagtattttgtcatttttttatcatttttgaagtttgtgaaataattagcggttttgttttcatatatatgaattcttgtcataagggatctctgttgactcagacataaaaaatgaatatactgttagtacaatagattggaggaattccatatgaaccaaaatacaagtatcggagaaaaaatcaaggctctacggacttcgcagaaccttacactcaaacagcttggagaaatgacaaacctttctaccgggtttctttctcagatggagcggggcctgtcctccatcgcgattgacaccctggaaaccatcgccggtgtgctcggcgtaagccttggcagttttttcagcgaggaaccgcacgcagactgttcggatccggtggtccacagcttttccatgcccaccacacctgtgggccctcagattattcagaatacccttagccacgatgtagccgccttcgattttctcccccgtatttttacccttcttcctctcgccaacacggaggaggaaaacctggagatgtacagccattccggggaagaattcatctatatactggaaggtattgcgacgatccagttggagtcgattcagtatacgctctatccgggcgacagtatccagattcattctaatgaaaggcataactggatgaaccacacaaacaaagttgtccgtcttttaacagtcaatattccaaacccatttcgttcgattgaaagcggacacatcatgccgccggaccttaccctttagacgcacggaaaaaggagatatcgctttagacgattttcgttcaagcgatatctcctcttttcgtttttctttatttttcatccatgagatgacatgctactttatgtcctggacatacttcccgtaattccggcacttccttaaagcaacgctctgtcgcgtattcacatctctctgcaaaccgacagcatgccttcggattaatcgggcttgggatctctcccttaatcggaatccggcggttcgcttttgccttgtccggatccgcctccgggatcgcggaaagcaacgctttcgtgtacggatgctgtggattgctatagagctcttctgtctctgcctcttcgacaaccataccaagatacataacgattacacggtccgaaatatattttacgacactcaaatcatgagcaacgaacagataggtcagacctctctgctcctgaagatctttcagcatattgatgacctgagcctggatcgaaacatccagagctgagatcggctcatcacagatgatgaattccgggtccacagagagcgctctcgcaataccgatacgctgtctctgtcctcctgaaaactcatgaggaaaccgtgacatatggtctttgttcagaccaactgtctccagaagctcctgcacccgcttctcaatctcttttttcggcgttccgtgctgttttaatccttccccgacaatctctctgaccgtcatacgagaattcaaagaagcatatggattctggaaaatcatctgtactttctggcagaacttcttctgctccgctttggaaagcttggtgatatccttgccgtcatagaacacttctcctttagtcggctcatacaggcgaatcatgcatcgtcctgttgtagatttcccacatccggactctcctacgaggccaaccgtctcccctttataaatatcaaaggttacatcgtccacggccttcaattccgcatgtcttcctactttgaaatatttacataaatgctttacctgaacgagaggctgtttttctttattttccatctgctacctctcctttctctactgccacggcttcttctttcttaaattccgtatccggggcaaattcatgctgtaaccaacaatttgtcacatgttcttctgataaccgatatttatacggcggattctccttacatacgtccatcgcatattcgcagcgagctgcaaacggacatccctttggcgggaaaaacagatccggaggagtaccttcgatcggtttcagtctctcgccctttttcgtatcgagctttgcaatcgaatccatcagtcccttcgtatatggatgtgctgtattatagaaaatctcctgtgcagttccctgctctaccaccttgccaccgtacatgacaacgacacgatcgcacattctcgcgataacaccgaggtcgtgcgtaatcataatgatggaagtaccaagcttctccctcagttccagaagcagatccaggatctgtgcctcaatcgtaacatctaaggatgtcgtaggctcatcacaaatcaccagactcggccggcttaccagcgcaatcgctatcatcacacgctgtttcataccgccggaaagctcatgcggatactgacggtaacgcttttccacatcagagattcctaccagcttcataatctccagtgccttctctttgacttcctttttagagacgccggctcgtccgataaagacctcctcaatctgcgccccgactctcatcgtcggatttaaagacgtcatcggatcctggaatacaaaaccaatatctcctccacgaagctgacgcaactcttttttatccatcttcagaacatcttttccattgaaaagaatctctcctccctcgaagaatcctggcggctccgggttcagacgcataatgcactgtgctgttacggattttccgcatccggactctcctacgattccgaggatctctcctttgcgtacttcaaagctgacgtcgcggacagccttgacctccccaccataggtatggaaagagtacacgacattttttaattcaagaagtttctctttttctgccatttcttccgttcctcctattccgttccacgcagtttcgggtcaactgcgtctctaagtccgtttccaagaaggttcagcgccagcattgtcgtacagacaaagaatgccggaaccagaatctgatgcggataatagcgcagatactgaattccctctttacagatcacaccccagctacagtcaggaggtgtaataccaagtccgatataggacaggaatgcttcctggaagatcgctcccggaattgccatacacaggtttgtaacaagcattccaaggatattaggaataatatgtttgataataatcgtaaaatccggtactccgagcactttcgccgccatgacgaaatcctgctccttgatccggtaaacctcaccacggacaaaacgacaggtaccgatccatccgacaacgcacattgcgacgatcaaaggcgtcacgcctttcccaagtaccatcataacaaggatcgtaataatcagacttggaataccatagagcaaatcaacgattcgcatcataatcatatccagtttcccgccgtagaatccgcaaagtcctccgatgacggcgcccacacacatattcaggatagcggaaatcaaaccgatagaaagggatacacgggctcccatccagatacgcgtccagagatcacgcccggtagagtcggttccaagccaatgcgccgccgacatcatcgcgtttctattgtctacgtccatctgggactgtgtatactggctgaacatcggagcaaaaatcgcaagcagcgcatagagtactacgatacaaagtccgatgaacgcacttttatttttccgaagccgtctccacgcatccgaccagaaggagagggacggccgactgatactctccatgcggacagtatcttttcctttgataataaattgttcttttttcaaatctgccatatctctcacctacttctttccaatacgtacacgtggatcagccacaccgtaaagcacatcgactaccaggttacagaacacaaggaagatgccatagaatacagtcattccaagtaccatagaatagtcgctgttggaaacactttccacataatatttacccattccagggatcgcgaaaatggactcgataacgaacgtaccggtaagtacggacgctacggtcggtcccatgacggtcataaccggcatgatcgcgttacggatctgatgcttgcatgtgatccgaagctcggatactcccttagaacgtgctgtcttgatgtaatcctgagacgttacttccagcatacttgcccgcatgattcgcgagacggaagctaacgtataaaatgccagggcaaaggccggcaaaatcgtatactcaattccctcatatctggcgactgggaacagcccccatttgattccgaagaaatactgaagcgcggcacccatgataaagtccggaatactggttccaagtactgctacgataacacagaagaaatcaagcttctttcccctgtttctcgcggaaacgattccgagtacaagaccgatggaaagcgccagaagaagggcacggataccgagatccgcggagaacgggaatgtctccccgataatatcattgaccgtcttatttgtatatttcatggaataaccgaaatctccatgaagcagattcaccatatagattccatactgcacaatcatcggcttgtcaaatccatagtacgcttccatattcgcacggacttcgtctgtcagcttggcgcttgtaaacggatcacctggcatcagacgtacaaggaaaaatacgatggtaatcaatacccagatcgtcaggatggcagcaatcactcgcttgataatatattttgccatattcatcctcctgctgtatatgaaatcatccaggaaagatcagattcccctgcttgggctttcctggatcatttcttgctttcaatatttccgctgtccggacatctttccggacagcgggattttatctcgtctgtttttcaattcacttttattctgtcatgtctacatatacccagtcaagattgattgagctgtaaaattgtacaagaccttccacattgtctctgacaaggtaatgaacctctctttctgcctgaggaagaaaagcagcatcatctacgatgatctggtctgcctgatgaagcatatccatacgttttgcagcatccacttctaactgtgacgcattcagaagttcgtcaaccttttcattcttatatctgctgtagttgtacgggctgtcggacttgaaaagctccagatagctgtatggatcatcgtaatctgatacccagccgccccatgcgatctcatagtcgccggactgctgacgtgtcagacactcattatatgtaacctgttcaatctcaattttaatgccaagggctttctgccacatttcctggcatacttcagcctgtttcttagcagagtcactatctgtcgtcgtgattgtcacagtgatatcagacggattggaaacgcccagctcggacatcgccgcgtttaagtactcttttgcttttgcctcatctccgtcaagtggatatgactgcagattcgactcctctccccatgtactatcaacgcctgtcaggccactgaaaacgacatctacgctcggcgcgtaaagcccattgtttacaagggtattgtaatcatttctgttcagcgcatagttgagggcaagacggaagttcttgtttgtcatcgccttgttctccccgccacagttgaagtagaagtagtctacgttaccattacggaagacttcagcttcatctttatatttatctgcggatgcggaaggaatttcaacgtaatccagttcgccgtcctcatacattgcaagggcagtctcctgattctgtacatagctcatctctgcacgatccagtttaatggaatctttgtcccagtaattttcgtttggctcaaatacatatttctgatttgcggagcttgtcagtttatacggtccggaatatacattcttttccgcgtccgccgcaaaatctttgccgtattcttccacgatatcctgacgaaccggcgcaaagtttccggaagcaccgatcagactcaggaaataagcggtcgggtgaaccaacgtaacaaccagtgtcgtatcatcctgtgctactacggcgagttcagacggatctactttccccttttcaacttctgcgccatttacaatatattcaccgatgaatgcatatggagccgctgttgcaggatctaccagtctctgccatccatatacgaagtcctgcgctttgatctgctctccgtcgctccattttgcgtccggattcagatggaatgtgtatgtaaggccatcttccgaaacctcccatgactccgcaactcccggcttaatctctccaccggtgtttcttacaagtccttctgtgatcgcatgttgaagttcgttgtcaggaatacaatttgcctttgtcggatccagagttgtaggctctgttctcgtagaatagcggaatactttctcatcgctgtctccgcccttatccttgcttcccggtgtgccgcatcctgcaagaagtgttcctgccatagctgctgccaataatgctgccaaaacttttcttttcataataccttcctcctttttaaggttttagagctctacgagctcgtgtgtagcacttatcaggttttcatatccgctctgagtgatgatcccctggtcttcgacccggatgcctccccagcccggaatataaattcccggttctaccgtcataatgttcccctcctggagaacagcgctggaattgcttccgataaatggtagttcatgtacgaacaatccaataccgtgtccaattccgccataattatattccatatatggtgtgtccttaatggccttcagtgatgcctcataacattctatgcctgtcacccccggtttaatgaccgcttctacatcttctgtcatctgtctgcaaagatcatatacctttctctgctccggtgtcgccttcccgactacaaccgtccttgtcatatcagagagatagccatgatactgacatccataatccatcagaaccaggtctccatactgaatcgccttatctgacggaattccatggagaagagacgtcctcgctccggagatcaggattcctccatatggcttggtgtctgctccttccatcaccatataatgggaaagtctggacgcaagctctttttccgtcacgccaacgtggatatcctggataattttatcaaatgcccgggacgcaatctcacacgcagcccttaaatatccctcttcctcttttgtcttaacggatcggaattcctcaatcacatcgaccgtaggtaccagttccgcgtctccctggcttcggatcgactcataaaaagaaaaggtgagataatcttcctcgaaagcgatcgtttttactcccgcttcccttgccaaccgttgtaccgtcataccaatcgtattctttggtgtcctccagtttaccacttcatagtccggacactcataagacgcctgctccgtatatctcggatctgtgataaaaaactgcttcttctgtgtcacaagcaaataagagtcgtcccctgtgtaagaactgatgtatcggacattggccggtttcgcaataaagaaagaatccacctttttctcttccataaaatttctcagcttctggatggtatccatctggtattacccccccccctatcgaaaatgtatatttatattatatctatttatcaatgattgtcaacctgacaacaaacattttgtcatgtttttccccatttttcgatattcttttattatattcgttattcttttatcattttcatttattttttgtttactatttattattttctaacaatttgtttttgtcaaaaaaacacttgtgcaatatacactagaataaagttcattttttgtctactatttcacataattgaaaactttataaattatataagttgtcactttttgtatttttattctttaaatatgcatttttattccagtatttgctattattacaactgtttttatcaatacctattaccctttctggatcctttatgcaaatttatatcccgcagaaagttgtcagagctcaaatagattcgcaagtactaaacattacattttagaatgacaactagcctataacgcaaaaaaaggatacagggatgatcgtccctgtatcctaaaagtatctgtcatattatgaccgttctttattctgtttttccgtacagtgcaacaagtttgttcagatattcatatctctcttttgcttcctgctcgttcttttcgaataatacttttgctttttccggatcctgtcttacaagagagttgtaacgaacttctccgttcaggaattcctgataatctccggtcggagccttgctgtccaaagtgaacttgttttccgcagctggattgaaacggaaattgttccaatatccgcactctaccgcaagctgttcctctgtctgagctttgctcatgcccttcttgataccatggttgatacatggagcgtaagcaataatcagggatggtcccggataagcctcagcctcagagatcgccttcactgtctggttgaagtcagctcccattgcgatctgagcaacatatacatagccatagctcattgcaatacctgccagatctttcttcttggtttcctttccgcctgccgcgaactgtgccactgcacctgtctttgtagccttggaggactgtccacctgtgttagagtaaacttcagtatcgaataccataatattgatatcctgtccgcttgcaaggacatgatccaatccaccgaatccgatgtcataagcccatccgtctccgccgaaaatccactgtgactttttagcgaggaaatctttattatttacgatatccttacatacttcacagtcacatccagaaagtgccgctaccagcttatctgtagcagttccatttgtagctccacaggaaaaggtatcaagccattcctgacatactgccttcacttcttcggaagctttatcagatgccgcgacagattctacttttgctttcagtccatttctgatcgctttgtttgcaagcatcataccgtaaccaaactctgcgttatcttcaaagagggagttagaccatgcaggtcctttaccttctgcgttcacagtgtaaggtgtagatggtgatgagttaccccagatagaagaacatcctgttgcgttcgcaatatacattctgtctccgaataactgtgtaacgagttttgcataaggcgtctctccacatcccgcacatgctcccgagaactcaagaagcggctgcttgaactggcttccctttactgtattttctttaaatttggctactacttctggttttaccggaatctctcttccgaaatcgaagtatacctgttctcctgcattcgcttccatgttacccataacaagagccttctcgcccttcttaccaggacatacatttgcacaggaaccacatcctgtacagtcgtaagcagaaaccgtgatactgaacttcatatcaggcataccgatcatcggaattgtctggattccttccggtgcgtttgcagcctcttcctctgtcagagctaccggacggataacagcgtgcggacatacatacgcacaacggttacactgaatacagttctgaggctgccagatcgggatatctaccgcgataccacgtttctcataagcggccgttccagacggtgtggttccgtctacatagtctgtaaacgcagatactggcagggagtttccttcctgagcgtttacttttgcctgaatattcttaacaaagtctacaacttcttttcttccgcctttgacttccggtgtgaataatccttcatcagcagcgtctttccagctttccggtacagcaacttctacaacctgttttgcacctgcgtcgattgcgtcgtagttcatctgaacaatcttgtcaccttttcttccgtaagtagcttttgctgccttcttcatcaggtcgatcgcttcttcctccggaatgatggctgccagcttaaagaacgcagactgaagaatcgtgttgatacgtcctccaagtccgatctccttaccaatcttaataccatcaatcacatagaacttgatgttgtggttagcgataaatgccttcacctgtcccggaaggtgtttttccagtccttccatatcccatgggcaattcagaaggaacgtacctccgtcaacaagttcctgtaccatgttgtacttgttgatgtaggacggattatggcatgctacaaagtttgccttcttaatcaggtatgtggacttaatcggtttctttccaaaacgaaggtgggacatcgtcacaccgccggattttttggaatcataatcaaagtatgcctgtgcatacatatctgtattgtcaccaatgatcttgatagagttcttatttgctccaacagtaccatcagcaccaagtccccagaacttacagttgattgttccttctggtgtagtaacaagtgcttcgccctcatccaatgacaggtgtgttacgtcatcaacgataccgattgtgaatctttctttttctgtgttgttgtatacagcaacgatctgagccggtgtcgtatctttggaacctaatccgtaacgtcctgtaagcactttcacgccgtcgaactttgttccctttaatgctgcgacaacatcaaggtaaagcggctctccctgtgctccaggctcttttgttctgtcaaggacagagatcactttcacactctccggaatggcctcaataagcgcttttgcgctgaatggtctgtaaagtcttacctttacaacgccgactttctcgcctttagcgagcagataatctactgtctcgtcgatcgtctcacagacagatcccattgcgatgatcacatgctccgcgtcttctgctccatggtaattgaacagcttgtagtttgtaccgatcttcgcgtttactttatccatgtactcctgaacaatagccggcatagcgtcatagtacgggttgcatgcttctcttgcctggaagaatacgtccggattctgcgcggaccctctttcgcaaggatgatttggattcaacgcatgtttacggaatgcgtcgatcgcatccagatctaccagatctttcagatcttcataatcccatgtctcaatcttctggatctcatgggatgtacggaatccatcgaaaaagttgataaatggaaggcgtcccttgattgccgcacagtgggcaaccggcgtcaggtccatgacttcctgaacactggattcacaaagcattgcacatcctgtctgacggcatgcgtatacgtcagagtgatctccgaaaatggagagcgcatggcttgcaagcgcacgggcagatacattgaatacacccggaagctgttcacctgcaatcttatacaagttcgggatcatcagcagaagtccctgagatgctgtgtaagtagttgtcagagcgcctgctgcaagagaaccgtgtacagcacctgctgctccggcctcagactgcatctccgtaacctgaacttcctgtccaaaaatgttctttcttccctgggtagcccactcatcagtagcttctgccataacagatgaaggggtgatcggatagatcgcggctacatcgctgtatgcatatgaagcatgagcggcagcatggttaccatccatggttttcattgatcttcccatttctttattcctccttaagtttcaaaaaatgtttctaaattcatagatattcatattatatcgccattacctacaaaagtccagtagactcgtcccataattttgtacctttttgtgaacaaaataactattcacagccaatatctttctttcaaaacgagcagcaaaacgggcgtcctgcctctgccgtttccgacagcttcatggcgcccgtctcccttatacgttaaaccggaacaatactacatccccgtcttttacaacatactcttttccttcggaccgaaccagacccttttcctttgcggctgtcatattgccgcaggcgatcagatcatcgtaggccacgacctctgcccggataaaacctcgttcaaagtcagaatggatctttccggctgcctgaggtgcttttgtacctttcttaatcgtccacgcccggacttccggctcaccggctgtcagataactgataagcccaagcagacgatagcttgccttaatcagcttctcaaggccggactctttcaggccgaggtcttccagaaacattgctttttcatcctctttcagctccgcaatctcctgttcaatctccgcacagactacgaatacctcgtatcctgcttcttttgcgaacttgcggacttcctgtacaccttcgttcgcgacaccgtcatccgccagatcgtcctccgaaacattggccgcaaaaatcaccggtttggcagtcaggagattgtagctattcatccactcctcttcctcctcatccctgaaatccgcaaagctgcctgccatctttccttcttccagatgcgctttgattctctgcatcagctctacttccttggcggccgctttgtcgtttctcgccgcacggatctgtttgctgatccgtctctccaacacttccaggtcagaaaaaatcaactccacgttaatcgtctcaatatctctaagcgggttgatggatccatctacatggacaatattaccgttttcaaagcaccgcacgacatggacaatagcatccacctcacgaatgttggcaaggaactggtttccaagtccctctcctttggaagcccctttcacgaggcccgcgatatccacaaattcgataaccgccggaacgatctttttcgtgtgatacatctcgcccagaacatttaaccgctcatcgggcaccgtcacaacccccacattcgggtcgatagtacaaaacggatagtttgctgactccgctcccgcttttgtcagagaattaaacagggtacttttccctacgttaggtaatccgacaattcctaatttcattttatgctttacctatccagaaagccttgattttactggctttctgcctttctctattttttgtttacaccctttttacaccctttttattaactggcggtgtaaaactttcaaattggtgtactgcgtttaccagtgattcgtccgtaacatgaacatatctgtccatagttgttttaatacttgcatgacctaatagctgctgcaaaacttttggctgcataccgcgctcaatagcgcgggtagcataagtatgacgcagtgcgtgcatacaaaagcgtttaattccggcttcatcacacaatttgtaaagatgtgtgtcataggaactgtttttcgcaggttcgcctgttcgccagttgacgaaaaccaaatctcgcatgacaaggcacttgttttctcctgttcggctgtctgtgtattctaaaatctgtgacagcgtttcagcttctttacggctgcttctttcatcatagcagcttttaagaatagaatatgctttgtcggtaagtggaatggttcgatagctctttttcgtttttggcggtcctgctcgccagtaaccttgcttatgccgatactctaaactcttgtttactgttaaagtgcgccttttccaatctatggagtcccatgtcagcccaatcaattcagccgttctcaatcctgtttccaacaataaagcgtactgtctgtaattgtgggagcgtttcgctgcttcaaggaacttttcttgttcctcaacagttagatacttaatatcatctactgcccgaacaggttttgtatagcgtacaccgttcatagggtgtttggcgataatatcattcataactgctgatttaaacagggttcccattgtaatataagcctgtcggatagttgagcctgcataggtggcttccattcgatttaaaaccgctttacagtgcatgggctttacgtcgcctatacacatggttcctattactggttgaatattccatttataacgctcccgataatttctttttgtattcggggcaaggtcacaaacgatatttccaatccaataatcaaaccatttgtctaccgtcatatccggcgcggtaacaattaagttgtgacgttcttcgtatttggcgtcagcaagccaattttttgcttccggcagcgttttgaaatatccgttttgccgtttgccgtttttggtataaaatcgtgcgaaatataaaccgtcctttctttggcaaatacccttaccacattctttgcctttcagattttttcccattatccggactcctttcttcaataaaaaaagagtccaacgcaactataaagtatagcacaaagactctgttttttcaatcgtaaccgaaaattctttcgcaatccgggggcgtcaaattacaacttctctttggataaattcttcaaattcttttcgttttaccagtttacgggtaccaacgaatagaacaaacggacaattcggttgttttaacatggtatcaattttattgattcctatattgctatattcggcagcttctttgattgtcaaagtcattttaagatgtataggtactttttcttcctctctctttgagaatgactcattttctttgcttccgaatgttgttctccctatacactttgatgtgtaaggggcgttttgatttgtcataaagatttcccctttctcaaagttaaaataaaaagagggctttaatcgggcagctatcagcatagcgtcatgggagttccacccccgcgtggttctcacgcagccccacccgttgcctgcgacgctttgaacgctcggactacggcggtagggaagtatcattataccgatatatggattgtggcggcagagttgctaagtctgctttggaacactgatattcttcgctcggtctgtccctcctttcgtcgtcgcgtatcagcccaacggctccccatatatcgaatgtacccggtttgccctatactgcgtcgccgttatcttgcgtcgctttctttgtcaaagagcagaaaacaggttaagcagcaaacagcggaaagggggacgctgtttgtccgttatcttaaaccttgaatgacaggacagcccgcataagacgcgaacgcaaacggtcgcgtatgtcctcgtctatgccgtaataggtattcccgcgctcgtcgcgcagcttccgcatagacaggtatgctatgtaactttcgtaatgctgtacgacaatgttcatagcttccgggtcgccctttgtggcggctatgattaccgggtaaggtaataagccgctttcagcattttcagtattactaacctttgtagtcatgggcgcgttcctccaaatagcgttttaacagcttcatagagcttgttcggcgggtctgtacagttgtcctcggaatgttgcagaattttgcaatctcccgttcactcatatcaaagaagtaatacagcagtacgatttcccgcttttcttccggcaaactgtgtagggcttcggcaagcagctccgcagtaatttccttaccgccgactacaaaagactgttcagcgttatcttctgcaaaataatcgtcgcagataaaaagctgattttcttcttccggcgacagctcggaaaaggtaacttcgcgtaattgccgctgctttgtgtccctatgggcgttcatagcttcccgccttaaagacagtttgcaatagccgttaaaagcacaacggatttgccactgggtacgattaggttcgttcatgttctcacctcctttcgctgccgcgaaagcggtggattttgaaatgtcccctttcgtaaaccctcaaaccaacaaaatcgaatttggacgttggtttcggggaatttccccatatttttttaaagaaaatgcaaaatgcgcccgtctgcaaaatgcagacaggcgcaaaagagatgttaaaagtatgatgatgatttaacagttcatctatgtagtcagaatatcccgttgcaagaggtgggctttttttgataaatactcgttagcaggtggggaatgataaatgcaaaaggacataatgatacctccttgataccgccatatccttaattaactttcccgcgtattgatgaaatgtgaaatacagcggctaatctattgcagaacagaaaagagccgataaccgcattgtctgcgcgttatcggctctgcgtcttagcgtccggctctgtgataactgatatgtttaatttatttgctcgtattaacatttcttgtttgcatttgggacagtagagagggaagttttcaagtattgtatcttcccgtaattttactctcgttttgccaccacatagcgggcacaaaatccatttatctacttgcattgcaccacctcaatcctatatccggaaaaataaatcttacttttccaaacggaaaaaaacgcttcgggcaagtatgcctatcattacagcaatcactgatgtaccaatcaaaacgatatataagctattagaaaatgtgtcaaacagcaaaccataaagagattgccccaaaggttgagcacacattgtaagtgtcatagtgtaggctgttacctttccaagtaaatgattgggtgttttcctttgcgtcgcggatagtacaaaaattgaaaatatcgtaatcagtaattgcagtaacatcacgcaaactgtgataacgaaatagcataccattgagttaaaatcaaacaagaatacaagccctatcgggataagggatattccagaaataacaagcagaagatataatttgcctgttttcagtcggtttgcaatcaatccgctgattattcctccgactatgccagcccccgccataagtccctcggctgttccgtagagttcgctgctcaactgtaaaatagtccgtatcatatatggcataccaatagtaataattgaaacaatgaaaaagttataaaatgccattaccaacatagtgcgtaaaatatccggctgctctttcgacataaatctaatactttccttgaaatcgctttttacagtttgcaccatactttctttttgctttagtttttcaaaaggtatgtaaataaatatttccaaaattgctgataggaaaaagcaaacaccacttacatagataatcgggatagcaccgaaaaatccgtataaaataccaccaagaataggacccaaaaggtttgcaagcatggttacttgattgacaactgaatttgcttttacaagatttttttcatcttgtagtaatggaacacttgaattaaccgacggagtataacacgcctgtatgatggataaaaggactaatactgcggcaatcagcggaacagcatttttatccgaaaggctaaatccaaagcctaaaaccaaaaacgaagtcaagaaatcaagcactaccatgatatttctgcggtttacgcggtcagcaatcataccgccaaaaggcgaaagtataatcgttggaatgaccgaaaacgctgttactgttccaaatatcgttgcagaaccagtaatatctaaaacatacaaggcaagtgcaaaacgaagaatggaatttccaaacagagaaataagctgcccaattactaccatgacaaagtttcgattaaaaagtttttgcttgtttatcatagttgcttcctccatgtctattttttgcgtacaaagagcaattctgccgtctgtaccgcaagtataattcctccgccaattaagcaggcttttgccgctttgtgctgccccttttcttctaacggaatataacttgccataagccctatacccgttgcgaatgtaagagatttggataaaaagcgtactgggcgaaacttccaagcgtaattcatagatttatcaaaagctgtcgctgctccctcaacagttttttcaaccgtatctccaaattgctccataactctttcaagtctttcttctgtcataaaaattacctccttaaatacatttggttggtatgaatatagttataaaagaaagggctatgccctaaaataatacctaacgaatgaatgtatatttgtttgataaaagcaccttttacaaggtacttttatagttactctgcaatttcctttatgtgcctttcgacaagctcttttagttcactatcaaacagcggtattcccatagtatctaaaatagtgctaagacaatgaaacttattttctatttctgctgcggaagccggataaattgacggggataaccaacaatcactaagtaatggaattaactcggacaattcctttgcatagcttgttttgattgaaccgtcatgttgtccttcttctatcagctctaaccatagaggagaaatcaatcgtctatcggtatcaatcattccggctaaaatacgcggatttttgagaacaggaagtgtgtgcttactcaattctgctcgttctacgtctgcataattgattttgataacttcacgcattttctgtaatccgttcaaatcattacgtttcttgacaagagtaaaggggttattatcaaaaaacatcttatcactcagagcgtccataatttcttctttggatttgaaatgatgataaattgcaccctttgtaagacccccaagttcatttacaatgtcctgaatagttgtgttatcatatcctttctctatgaataatcgttgagatacttccagtatcttctcaatcgttacttcgggatatttgtttcgtgccacgccaatcctccttactgttatcattcgtttggtatgtaattctattatatacagcatagcagggtttgtcaagatacattcggtaggtatttatttccacataaagctcacataatatgctttatttctatccatactatgatgtgtgtaatcatatcttgaaaggaagatgaaatatacaatgtagatgggtgaaataactatgaagcagagcaaagaaaagtttgattttaaggctttcggacaagctatcaaagcggcaagaaaagcaaagggaatatcccgcaatcagctagcggacaagctgaatattgcgccgcgctatatcgcgtccattgagaacagcgggcaacacccaagtttacagattttgtatgagcttgtaaccttgcttgacgtatcggtagaccagttctttttcccagaacgggaacaagagaagtccacccgccgccgtcagcttgatactatgcttgacagcatgagtgaaaaggacttgaaaatcctatccgctaccgcaaagggaattgaggaagccaacaacgaaacaacgggggaatgaaaattcccccgtttcttcataaagattgtttgaagcgtcgcagattgcggcgtttttcttttgcaaaagtccgtcatttttgcttttctaagtgttgtaggtagtgtaggaataagtttcttagcaagcataggaaaggggtaccctttccgtattttcgccctcctgcgtctgcggcgcgtcggttaaaaattgcttgttgggaagtgtcccaaaccctctaaaaacggaaaggagcgtcagagcatggacggacggaaacggacaatacaaatcaaattcagagtgacagcggaagaacgggcgttgattgagcagaaaatgaagctcgtccctacccggaatatggaagcctatcttcggaaaatggcaatcgacgggtatatcattcagatagaccatgccgacataaaagccatgacagcagagatacagaaaatcggcgtgaacgtcaaccagatagcgcggcgggtcaatgcgacaggcagcgtctaccaagaggacatagaggaaataaagggggtgcttgcggaaatatggcggttacaaagattaaacctattaaaagcacgttgaagaaagcccttgactatatccagaacccggacaagacggacggaaaaatgctcatatcctctttcggttgttcgccggaaacggcagacattgagtttggatttaccctttcgcaagcccttgaccggggcgacaacttagcccaccaccttatacagtcctttgagccgggggaagtcgattatcagaaagcccatgaaatcgggaagcagcttgccgacgcggtaacaaaggggcaatatgaatacgtccttactacccatatagacaaggggcatatccataaccacatcattttttgtgcagctaactttgtagactaccgcaagtacaattccaacaagcgcagttattacggcatacgcaatctaagcgacaggctgtgccgggaaaatggcttatccgtccttgtgccggagaaaggaagccggggaaaaaattatgctgtctacaagaaagagaaaaccgcaaagggcaggctaaagacagccgttgacgcgcttatcccgcaggtttccagttttgaagaattgctgtcccgtctggaagcggcaggctatgagattaagcggggaaagtatgtgtcctgtctggtgccggggcaggaacgatataaaaggctgaaaaccctcggcgcagattatacagaggaagccataagggaacggatagagggcagacgcgcccgcagcgtcaaagctccaaaggcagagcgcggcgtttcgttactgattgacattgagaacagcattaaggcagcccagagccggggctatgaacaatgggcgaaaatccacaatctgaagcaggcggcaaagacgctcaacttccttacggaacatcagataagccagtatggggaattgaccgccagaatagcagaaatccagacagagagcgaacaggcggcagagaacctaaagaacgcagaaaagcggcttgcggatatggcggtcttgattaagaatgtttccacgttccaaaagacaaagcccgtctatgacgcataccggaaagcaaggaataaagagagctaccgggcagcccatgagcgtggtatcattctccatgaagctgcggcaaaggcactaaaggcggcaggcgtttccaagctcccggatattaccgcactccaagcagagtatgaaaagctgcaagagcagaaagaagccctccgcgccgaatatgggaagcggaaaaaacaggtcaaggaatacgacgttatcaagcagaacatagacagcattttaaagacagagaaacaaccaaaacaggaaaaaggaaaggaacgggaataattatgaaaattgttgatgtgaaaccatgttacagaataacattagaaaatgacaactacggcgtagaaacctatattggtgcagacagtaagctgcggattacttttgaggacggaaatacccttaccggatatatagaatgtgtggaatatgggacttcccccgatgataataatacattggttatacgggtagaggacggcagactttatatcttattgggaaactggataaaggatatagaagaattatccgaataaaaaaaccggggcgcggaaagccggaaaaggctaaccgcgccccgcgtctgtgagggtgcctgcttttagatgttacgcagtagaacgccattttgaggagaaaaggtattctgtatcgcctgccctgttttcaagctgtcagagccgcataaatcaaggcttttttcgcccctaccgcgtaacaagggcgcgtcgtttcctcatgcgctccgctgcctgcctgcgggtaatgcgtttccggcactccgggcaatatttgacattgttggagcttgaagcaaagaacgcgccgcactcggcacaacgctttttgtcctcggtatggtaaagctccgcatataggagcttgtcggcaggaagtacggcaatacggaaccacttacagagcagcgaataggaaatgagctgcgggcagacacattcctccccgtcgtccagtaagatacagtgtccgttatcgcagttgcagcactcccgtttcacaagggtattgactttccggctttggggcggcgtcagccgcttaaccgcgttcatgcttcatcagcggcgcagatgataagctccgcaaattccgcttcggtcagcgcgtccactttggaaagggtgcgctgcgccagttcccgcatatcctcgtccatgtatggcagtgcggcggtcatattctctacaagctgctcccggctcccctcatggtagatactcaaaagattagtttcttcaacggtaaatcggttgtccatgctcatacctccatttcgtgttgttttgactttgccgccgcctttttcggggcggctttccctttgtctgcggcaagctgcgcccgcagagaggggcggggcttccttatgcccttgctcctgtcctcgttcttgtcaaccagggcgaatgtcccatgcctgtccccgatatttgaaaaagcaagggtcttgtagggcagcatggaaaacaggcggtcagcgtcctttgtggtcgcaagccgtacaaagtccggggacagctccaccatgaaatgggtcttttccgggctgttcggctcccgtaaagacttcattttctctgccacgcggcgggcttcccgttctatccggctgtcatgcagtgcgtcgatatgggctttcatgtcccccggcgtcagcgtttcccggcttttccgttcctccctaagtacctgccgcaaggcttccgggtcgttaggctgcgcttcaaagcgttcaaactttccaagctgcgggtctgggttcccgtcaaaatacgctccggcgggctgtgtgcgctccccatgctcataaatcagtgtgcagttgtcggcggggacagatttttcagccacacgccggaaatgctgcgggtagtccagttcgtaaaggtttcccatgagcttcccgttttcctttccggtcagctccaccgcgtaggcaaggacggtatcgtttgtctgttccccgtaatatttccatgtattgtgctgccttgtgtcctttaggaatacgtcgcgttcccggaagcagtatgtcccggacgggcgggataaccaaaggagctgcttatcctcggcggcagaccgcgccgccgcttcccgtaaaatctctttgtctatgtcaaaatcactttgaaaaaacgcagtgttctgccgcatgatagcgtcaagggacgcgataatgtccacctgttcaaatcggttcaatttcttcaatgggtcagctcctttccaagtcctgtgacttctgctttgagggctttttctgcgctgcctgctccttactggctttaagctgcgcccggatagatggcttcttttccggcttcgccgccttgcccggtgtgctttcttctttgagggcttttgcgtactcaaaaagggaaatctgttcgcctgcttttgcctttgcttccagttcggcggcggtgggggtattgtttatctgcccgtcaatcatgttgtaattctgttcggtggtctgctcggcagctttgaggggattttcccgctgcggctgcttttcctgtaaaaattccggcacttccttatatcccgcccggtctacatagtgggcggcgtcctgcccgttctgatgaagcactaccacatcagaaacggaaaggctgtgtcccttataatcttttgggtggtcgatattgaagcgggtaaaaatgtcgtcaagggaagttccggcagtaaggggcgcggtatagataagttcataattgccgcgctcaaccgcaagccctgccgcctgcaggcggtcgtatggctcaaaacggaagtcccgcgttcccttcccgtcctttagctgataaatggaaaaggtgtcattttcctgcgcggtttccggctgttcctgcgcctttgcatacagttctttgacttcgccctgcgtcagctccccggcgttaagctgccccatcagttcgcggcatttctccggcgtcccgatatataggacgtcgcctatctttgctgtcccgtcctcctgcgggagataggcttgcaggaaaaagcggtcattttggctttcgctgcggggattggcttctatcttgtagatgtattccggcatggcggctttttccctcggtgcgtcctctggctgctttgcttcctgctgttgctgccggatatgcgcccgctgtaaatccgtaggcttttccccggaaaggggcgcaatcgctttgacatagtttgcagcataataggcgttgtcattaagctgcctttgccatgcttcggctttaggcgaccaacggaagccgtttcgtttcaagtcctcccgtacatctgcgtccggcttactgtcaaagaagatttgcaggcggttgtcctgcgtgttggcttccaccttgccgccctcaaattcccacccggtatagccgatttctttctgccgggtaagggatttgatacggtctttcacgcgccggatttctgcgttgttgttggataacgcccatgagggataaggcttgtcctcaatgtgccactggctcgacattcccgcttttagcttttcgataccctccggcgataaatgggggcagccgtcaagagtcttatgcttgcggtaataggcgttgaccgctttcatggtttcctgcgatttttccagtccggcaagtttcttttccaacttctgaacggcttgcgggtcgtccgcgctgataccgcccatgccggtactgcggattttatcaagcaagccctgtatttcctgccattcccggtaattcgtatcgcgggcggcgttctgcttttctttcttacggacagggaaatttgagccgcccgctatgaggatagaggggacgcgggcgtcaatctcataacctttattcatgttcgccgccagtttccgggcgtaagtatcaagcaggctgtcgattttgtcatggtacatggggtctgtccgcgccttttgacgctcggcaatctttacggcttcgtctacatagtgcctgtattcagccgttgcgctgcccggttggtaatcggaaaagctgttcatgtcctttgcgcggcgggcggcggcttcgttgattgtgtaataaggggcggcgctctggggcgtgttttcctgtgacgcaggctccgggctgctttccggtgtttccggttcctccggctgcggtttggaagaaacggtttcttcctgcacttcctgttctttttccggggcggggtcttgcggctgcgtttccggctcggcggcttccggttccgctatggcttctgtctgttcctgctcatgtgccttttggatttctgcgaaatgcccgtctatggtttcaatcagctttgcggcggtgctgcggattgtttcaagggagcctttcagttccgcaagctcacgcccgctgctccacccggcaatatacccgaaagaatagtccgacgtatcaagcccgtagtgttggcagacagcataagcgacgctttccgcctgtacttcgcgggtacggcggtctgggcgggcagggtcgtccggggcggtatcgtgaagcgtggcatgggcgatttcatggattgcggtcttgatgttctggggttcgctcataccctcgttgactgcgatacgctgctcgttataaaagcagcgtccctttacgccctccggcaagggttgaaaaccgatagaaaagggggaagtcctttcaagggcagcgaaaaaatcatggtagtgcagcacgttcccggtcagctcgtcggtaagggtcggcagctcctttccgtccgtctgcgccacatcatacacgcataccacatgaaatttcggtatgataacttccttttcttctttgacgggctttccgtcctccccgataatgggtttcccggtttccgggtcggtcttatccactttcttttttactttttgaggggcgaaaatgcgtattcctttttcattttctttcacataacgcccgatagccgggtctttccatgcgttatagcccatgatatgggtagcgtccggggcttgcatggcaatcagtatggtattgtttaggctgtatcgtgggaattttgacatgacgcgcaggtaatcagaatagcgttcactgtcaaacatttcagaaattccctgttccagacgggcggtaacttccttaaccttttcttccttgtcggtagaagcagggataatcggcgtgaccgggcgcggctcggcggcagcttccaagtcgggctgctccggcggcgtgggcgttacccggtattcctccggcacgtccagtccgtcataccactgtgtaaaggtgttttgattgttgtagatgtagccctgttcggtaaacagtcctccgtcgttgatagcggcgtcccgcccgtattcctcatacatgaaatactttcttgcttcctccgggatttccggttcttccagctcttccacaaggtaatgcccgtaatcttcctcattcttgacagagggatacagccagtagcagtcaaggttctgtgcaaggttgataagctcctgtacactggaagcgtggtcgcccagtgtgacagcggcggtaaaaagctccttgtccccgtcgcgctgcatttccagaagttttgctaaatagttcagctcgtccgggtgttcattctctcccagacgcgccgccagtccggggattgcagactggtattcggtaaagtgccattccccgttttccttaaagtcaataccgatacggtcaaagacttcctttaggtgttcggcagtcgtggggaatgttacccattcgcccgcaggtctgccctcggtgtacttcctaagattagagaggtacccgcttaaaatcggttcgtccattcgttcactcctttctttctcaatcatgctttgcataaggttgtagtcctcaatgctcatactcccgtcaaatacataggggtcaaaatcttccccgtcccggaatggtctttcggaaaagggaagtccagcggcgtgggcggctgcccgccctttctcgatttcctccggggataggcggtcgtcgtgggcttcgataaattccttgatattgctgtacccgttttcatagtggtgccgtactccggcggtcagctcgtcaaggctcatatcctcccccagatagccggaatagtagccattaaccacaatcgcgccggggtctttctgccggatttcttcaaggcggcttatgtcatggggatagaggtagtcgttcagttccagatagaaataatcagcgttccaagaacgcccctctttccagaacgccacccagacaatccctgtccgcagctcgtcttgatattcctttacaatgtcgcgcaggcttgccatgttgaaaacctcctttctgcgcggtttatagagggtttgggacacttcccaagagcctgccccaacaggcgttagcctgtgagggtacaagcaaaaatccccgccgttcccggtagggaaagagggggattttacggaaagggtacccctttcctatgcttgctgcgttactttatttcttcggaagctccacccggtaattgacgtatttcccgcccgtatcggctaaaacaatgctcccggcgtaggttttgcccgttttcggggaatagagctttttcacatctgctttgccgttctttaagagcgcagcggcgattttcggggaaaaggttactttccgttcctcaaagaaacggtcatttttccacatggtaaagcagcactctttgttggagcagtaatagtttttcttcccctcatagacaggggagccgcagcgggggcatttcccggtttcctcacgctccggcgcgaaaagctgcgctttgtcgtcggaaaggaacggataggtctttacaagctcccgcgccatttcttcaatctcctgcatgaagcgttccgggtctgcctgcccctttgctatctgggtcagacggttctcccattctgcggtcagcttcggggaaataagggtttccggcaggacgcacacaaggttgataccgtcctttgtaggaagtagctgcttccccttacgggtaacaaagccgccgtttaccagtttttcaatgacagcggcgcgggtggcgggggttccaagcccccggcgttccgcgtccgggtcggtttcctcgttcccggcgcgttccatagcagagagcagcgacgcttcgttgtgtggctttggcggcgtcgtgtcatgctccgttacctttgccgccgggtgttcaaaggtctgcccctccaatagctccggcagcgcggacggttccccggcttcttcctccggcttccctttgagggtcgccgcaaaacggcgttctatctctttccacccggcagaaaggacggtctttcctttggcggtaaattcctgtcccgcgcaggaaaaaaccgccgtaaccgcttcaaaggtgtgcggcgcggcggctgccatacataggcgcgtcccggcaagggtaaggatatttcgctcactttccggcagcgcggaaaggtcggtctttgcaagctcccttgttggtatgattgcgtggtggtctgatacttttttgctgtttaggagctttccaatctccggcgaaaaatccatgccggacagaaaggggagcttttcgcagagcagcgttaccatgcccgccgccgtttctcccatgtcgtcggtaaggtatgcgctgtccgttctgggataggtcaagagcttcttttcatagagggcttgtgcaaggtcaagggtctgctttgccgtataaccgtaaatgcggttcgcttccctttgcagactggtaaggtcaaagagcttcggcggtgctgcgattttcttttcttttacaagggaagtacatactgcctgcgacgtttcgcaggatttttttaatgcctgcgcttcatcagcagcggggaaccgtttgcttacggcgtccgcgccggataaggaaaggcgcacatggtagtatttttctttcttgaatgtgctgatagccgcgtcccggtctacaagcatttttaaggtgggcgtctggacgcgccccacgtttaacgtgtggttgtagaggacagagaataggcgcgttgcgttgataccgattatccagtcggcttttgcgcggcagagcgcagaggaatagagagggtcatagtcctgcccgtccttcagattgtcaaatccgcttttaatcgcgcccgtttccattgaggaaatccataagcggcgcatgggctttttgcagcccgccatttcgtaaacgaaacggaaaatgagttccccctcacgccccgcgtcgcaggcgttgacaacttcggcaacgtcctcccggtgcataaggtctttcagtgtggcaaactgcgcccgcttgtcggcggcgacggtgtatttccattcctgcggcagaacgggtaagctgtcatagctccatttcctgtactgttccccgtaggcggcagcttccgcaagcccgataaggtgtccgacacaccatgaaacaaggtagccattcccctcgatatatccgtcctttttctctttcacgccaagcgcggcggcgatagtctgcgccacgctcggcttttctgcgataactaaaatcaaataaaaatcctcctttcagcgttccggctgtctgtctttttctatctttctgatacagtaccccacgcaaggggactgccccttgtaggggcagcccgcgcagcgcgggggaaaggaagcgggcggggacatctcccgtttcccatagtccggcttctgtatcatcattttttcaaagggattgtcggtaaacagtgtcatgcgtccccgtcctccggttccccgtcgtcggtttcttccggcgattcctccccggcttcgtcgtccccgtactcgtcgtattcgtcaaagtcgtactcgtcaaggttatccgtcccctttgtggcgtcctttttcggctttaggattttgaagtaataagcggctgcgcccccggctccggcaagtacaaggacaataagcagcatactcatgttgccgccgcctgcttcttcctcctgcgggctttccgtttcttccggctccggttcggctttcgcgcccgcacactggctgcggtcggtagcgcagaccgggcaactgatattgacttccccggcttcgcatttctccgtacaggtgcagactgcgggcgtttcctctttggtttccccgtcctccaagagcgcgttaaggtcggcgtcgtccacttgatttaagaaatggacggtgttttccccctcgttgtcccggtcaatgaggatatagaaatagtttccggctttggtcgtcactgtgataagctgcttattcccgccaaaatcatctacaagggttgcgttcccctccggggtaaggggcgcggtttcttccggttcctccacgattacgcccgtatcgttggtagcgtctgcgggggcgtctgtcccctgtgcaaaggcggtaacggaaaagccgcccataaggacaagggcggcgcaaagtgcggtcagcgttcttgtgattttattcttcatgggctgcgtcctcctgttccccgtcatagtccggcgcggcttccatgcccggaataccgccgtctttcagcatagcgtcaagctcctgcggggtcagcttcatagagcgtacaagctgtacgatttgcaggttttccgcttcggttttctgtgcttccaagcctttcagcctgttctggtactctgtgattttttcgcgggttttctggatttcccggtcaatgcgttcaatcttgttcatagccatataaaatttctcctttctaactgcgttaccagttcatcagcccgtaccctttgatacactgatagttcacgtcatagcttttaatcttgcaggcgtcgccggaattgccctcgacggtatagacgcggctcccgtcagtgccgatgacaagtcccacatggtcggcggttccgtctaagtcccagtcgaaaaagatagcgtcgccaggggcgatattttcatagccacgcgctccccattgtccccttgactggaaccacgggacgccctgtgactggcaggcggcaaaacgcggctccgataagcccatctgcccgtaacaccacgatacgaaacaggcacaccattccacgcgggaagtaaagccgtaccagctccaataagggtagccgcccacgtttccgacttgccgcttcgcaaggtcgataacctccccgtttccggggcgggtaccgtttacaaactgtacgccgcttaaatcctcggacgcggacgtatcgggggagccgccgccaaaaatcaacggcttgttcccgcttgtttccaagtagacgcgaaacatttcaagctgctccggcgtcagaagttcctccgcgatagaggaaatgggcttgctttccagtttgacgtttaagatgtaatactcataggggacttgtacggtataagtgtcctcatgctcgttgccgtcctcgtccgtccatgtgtcagtgcgttcttcctcccggtagcgtatctccacttcctcggtcagcgtaagcgtgtactgcatatcgaaaatacgctcgatttctgcctgtgcgctccccggcgtgtagctttggagcagggcagtcagataggacgcaagctcatgggggttatgcccgattgtgtcaaggtcataacggtattcgtcatagccggggtgggtgctttcgatagcgtcaatctcccgttgcagctcattttccatagccgcatagctgttttccaccgccacaaggtcgctgtcctcggacgtataggacgttcccacaacgccgtttaccatgccggaaaacatagccccgcaagaggacagcccggacatgatgatgataaataagagcagcgcggcaacagtgatacccacgcccgccgggtggcgcaggacaaaagctcccgcctgctttgctttctctgcggctttggcggcggctttccgggcgttcccggctgcgcctttgatactctttgcgctgcctgcccccgccgcctttgcatactggcgttttatctgctgtttctgccagaagcgggacagggggttgctcgtaagctgcgggttctcatacagggctttgtggtactggaagttgacgtttgccttaaatgcggctttttcagcctttgccgcttcccggtagggtttcagcttccggctgcgccgcccctccttgaatttccgtaccccgtactttgcgcctttctccgctaattcctcggatttgtgtgcgccctccacgccggaattgtccttttctacggaatgtaccttgttatggacgaaaatacccgcttcctgcgcggggcgggacagcgggtttctggcgtctttgctgccggggacaggtttttcccgttcttcaaagtgtaagcgggtctttgcctttccggtggcttcgtcaaaggtgcgctccttgactaactttttctgcttcgggattgctgcctttgccgcgtccagacggtcggcggctttgttggatttctcgatatatttttcaagctccggggcagcaagttcttcttcggtaaactgtaagcgtgaggttctggtctgcgcggcggcttcctcctgcgcctttcggacagcctttttgcttgccttgcgggtatgggcggcgtcgatacgctccatgacgcgctcggcttttccggcgtccggctttgcggcagcccccggcgcatgggggagaggggaagcgtcaaaagccccggaaaggggctgcgcgggttcctgcgccgcctgcggctccggcttcttctggaagtccgcttcctgttcccgcctgctcacgcgctcggcagtttctttggtttcgttgacttcgataagcccgtcgcgggtcattttctgcgtgattttatcacgcggcttgtactgttttatggtttcacacctccttgtcggctcatgcttcgcccacttcctccggcttcgtcgtcattaccttgtaaagctccgtatctttcgggaagcggtctacaaagggcagcacaacatttccgtaaaagataagcccctcgcccgcttcggtatgggtcacatacttcatctgctgcgggctgatgttgagctgctttgcaaggatagcccggtcgccctgtgcctgattgagcatgaggacaaaatcgctgttttcaaagatgttctccacttcccggcttgccaagaggtctttgacgttctgcgtaatagctgtgggtatctggattgtgattaacaggcggctttttatccacctctccggggctttcgcccattttcagcggtatgtcttttcatacccggcatagcatatctttttatcctatggtctgtgccatagaccgaaacgatagcgcggactcgtggggctgttatattctgcaagtacagtttcaagccctatgcgttgcgtgtgcgccgcccgttacagcggcgtttccactcggattaggattgcaaaacctttcccgttttcttccgcactggtactcttaaccgtctgtattcggttccggttaagacggcatacgctgtacccgtttgcaatattttaggtacaacgcttttttacctccccattttctaaaacgcttccaaatctcaacggaataagctgcggtctgttcctctttgagcagcaagtgaaactcgtccatgtagtagcgggttgcctttttctctgcccggtttatcgttacccggttccatacctggtcttgcacaatgagcatacctaactttttgagctgcttcccaagctgcttaatgtcaaagcagacaaggcggttagaaagttccacattggtacggtggttaaagacgttcaaagagccggaaacgtaaagctccaacgccgccgcaatccgcgccgcttccggctccggctgccgcaaaagctcgtcgtagaggtcgcccaaaatcggcattttctccgggtcggggtcggcaaggtacgggcggtagacgtttcgtacagcccggtcaatgacggtcttatcaatgggctgcaagccctccttgccgccgattaccagttcgcagagggacaggataaagtcggattttaaggcaagggggctgtcgtcctcactgtaattgaggtttatatccatagggttcacatactggggcttcccgtccatgcctttccccgtaggggagagccgtatcacttgcccgttcagacgctgcacaagggaaaaatactccgcttccgggtcgcagatgataatgtcgtcgtcggtaatgaggaaagcgtttgtcatttcccgtttcgcggcgaatgactttccgcttcccggcgtccccaagataagcccattcgggtttttgagctgcttcctatcgcagagtatcatgttgtttgaaagggcgttcaaaccgtagtaaagagcctgccccgtctggaaaagctcctgcgtgataaaggggataaaaatagcggtacttgaagtcgtcagccccctttgaatggggataaggttctcccccagagggacgctgctcatcaagcccgcttcctgctgataatcaaggcgggtaagggcgcagttatatttctgggcgatacccgccgctgcgaaaatgtcattttccagtttccgcttcgtgtctgccatgtttaccacaaggaacgtcagcaggaacattctttcattccggctttgtaaatcctgcaagagatttttcgcttcgctgccaaaggtggcaaggtcggacgggattatgtccatgtcgtagccgctgcggacagcttttttttgttcctcaatcttcatcttgtcaaggtctgtgattttgcgcttaatggtcttgatggcttcggtctggtcgatactgcggatatgcaagtttacgacaacgcccgtttccaagtccagtatgtccgcaagcatacggtcgtttaattccggcgcaaggatttcaaggaatgataccgcgccgattttccgccccatgcggaatgtgcgcccctccccaaaccggaaagaggacggggcgataaagtcctttgtggaaagccccgacggggcaagccagtcaaaagaaaaggaaaacggctccccgtccgggtggaacaccccatgcagcactttcaagcgttccgcgccgtttagggggtgtgccgataccccaagcactttaaggttgttgagtatgtccgtttcaatccgggcaaggcgggattttgccgccgccggattgtcggcttcaatggaaaacgtgatgtacttgtgcttcacaagcccgttgttccctttggagagctgatttttcagcatacccgcgtattcgctgcggatagagttgaaagcgtcgtcctgcgcggggatttcaacggctttttccgcttcctctttctgtgtgccttgattgataaaggaaagctgcactgatacggaagcgtcaaagtaattgagaaaatcacaccagttttcaaaaatggcggtcttgtcgtcgctgcccgcaagctgatagtttatatcttcaaaggcgacgcttttggaatacttcttatccgttacccggcagataccgtccgggaacatctgcaagtagggaatggtctgctgtgcggtgtggggcttgccgtcgccctttgcctgccggataatggtttcaatctgtttcttttcggcgcgggtcagcttacgcctgcctgcggcgtttttttcggctgtccgcgcctttgctgcctgtctgtttgacaatcgctgatacctccttttctaagtttctctgccgttccaaaacggcgtacaggttttccgtcttgtaggggcgttcttttggacggataaattttgtctggataatgttctttgctatcacttcaaggggctgtccatgtttctcatacatggcaaagaggaaacagggcagcatgacggtaatcatagccatagcggaaaggctcgtccccgcgctgtctttgagcaggaagaacagcggcagccctaagcataaagccgccgccagacaaataatctgccgcttcgtaaggttcaaagcgactttggttttgactttggataagtctttcggtacgggtacatacgccaaataaaaaacctcctttctgcggggctgtcccccgcttatccggctttagtgcgcttgaaaaatctgcttcgccagtgcgccggatttgaacagggagaagcagaggataaccgtataggctgcaagggaaaatatcgcgctgtgtaagttgtcggcaacaatcatgtcgtttacaaggacagcgtaaatgccgacacatatcataatgaggaagccttgaaagccaagggcgaaaagcccttttaggtagctgttcccaatctgcccccattcccggtttgtcatggtcgcaaaggggataggggaaacggaacagtaagcgtaaatctcaatcattctgccgtagaggataaccgttatcagtacggacatgattttcatgcaaaggctcacaaggcttgtttccagtaccagtaaaagcagttcggggacttccatatcctcaagcccctcctgcatggaagcaagggcttcggcagcgtcaatgctcgtttcgctgccgataacccccgccgcgccggaaacaacgtgctgcgccatgtcgaacaccgccattgtgatgtcaaaggtatgtgtcacaaggaataccgcgacaaatgccttgaagaaccacttaaaaaacatgaacgtgtcaacgtcgtgcagattgttcttttccgttaccatgctgataagctccacgcataggacgtaggtaatgacaagccccgctatggggacgataacattctctgataacgtctgtatcatggaaaagatgttgccgttccacccctgcggggtcttgcctacctcgtttgcgattgtgcctaccttttcgtttacgtccccgaacatagttgacagattcccgttaatggcaccgattaagattccctttatccattcgttaatcgcgtcaagtatgctctgcataggcggctactcctgcggcttatccgaaaagcccggtaagctgcggtacaaggagcataccgataagggcaacgccgccgcccgccatgagctgcttcattccctggctttttactgatgtgcgataaagaagtaatagaagtgtaaaaaattttgccattcctatccggcacttgcgcattgtgtcggataggtcgggcggttattcgggcaagtccaccttgccaacaaaagaataataaatctcaatgtcctgcctacgggtcttgttctcgtcatagctgcactcatgcacaacgattttctctacaaactcccgcagcagagtaggggtaagttcttcaaagctggtatgccgccggacaacattcataaacttttctgcgttcacggtggcttcctgtgctttggaaagctccgcttgaatagcagcggctctttctttcagctcccgttgctctgcttcatagtctgccgacagctctgtgaaacgctcgtctgatatgcgcccggtcacgctgtcctcatacagccgcttgaagatagcggataactcggctatgcgtttctcggaggcttccagttcctttttcttggcggcgttcctgcgtttgcccccgtcctcgttctgctcaatcaagagcttcataaaccgggcttcatgctttgccgcatagctggtcactttccgcagattggagagtacaccagcggtcaagaggtcggtgcggataaagtgcgccgtacagtcatgggtgcgtttcttgtagttgccgcagatataacagtcctgcttgcgcttgtccgtctggtatcgctgctgatacatcacgttgccgcagtccgcacagaacagtatgccggagaacaaacccacttcatcatagcggttggggcgtttgcgctgtttgcgaagctcctgcacccgttcccatgtttgggtgtctatgataggctcgtggtggttctcgaaaatcacttgcttttccgggggattttctacactgtgcttgactttgtaagaaagtttttctgtcttgaaatttaccagacagcctgtgtattcccggttttcaaggatatgcactacggtattggtcgcccacttgcactcatagccggggtggtagcggcgggtgctgcccgtcctgcggtattccagcgtccccggcgtggggatttgctgctctgtgagcatacgggctatcttggtcggaccgttcccggcaaggcagaggttgtatatctgctttactacgggtgcggcttcctcgtcaataataaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaagtcattgtcgccctgtgcgctgtccactccgtcattgatagcgatgaagcggacacctttctgtgggaaaatcatttccgtgtacattcccacttgcaggtagtttcgccctaacctcgacatatcttttacgataactgtcccgacttttccggcttcaatgtccgcaagcatggcttgaaaaccgggtctttgaaagttcgcaccagaataaccgtcgtccgtgtaccagcgcagattggaaaagccgttctgctttgcataggtttcaaggatacgcttctgattggaaatggaattgctctcgccttgcagctcgtcctcatgggaaagtcttgggtaaagggcggtaattggttgttggttggtctgtcttaacataaaatcctccgtttccgacagccagccccactattccgtatcttaattgtaccacatggggcggctgtctgtatagcggcaaaagcgtcaaatctgcttctttatggtcggtcaaatcgccgttttttgtgtagcagcttccgcttccagcactttcatcatcttgtcggctgcggtgtcggttgcaccctgcttgaagaagccggaaacggtaaggacggagttgcccatgcggatttccgttacacagtccgggcggcggtctgttttggtggtgcttgtctgtttggtttctgtcataggctctcctttcgctgcttcatcagttgctttaagcgttccagcttttcctgtgcggtttcctttcggaagttgctgcccgtgaagcggacgggggcgcacatggaagtcagcctgtcatagatacgggcgtggggcgtgtcctgcgggtgctgcaattcctccagcgtgaggttggtcgtggcgatcagcggcttgccgcttcggtaacggctgtcaatcacgctgtaaacctgttccagcccgtattccgtccctcgctccataccgaaatcatcaagtatcagcagggggtagctgcaaaggcaggaaatatattcgttcctgccctcaaagctggcggcaaggtcattgagtatcgttgcaaagtttgtcatgcacaccgggacttcctgctccataagggcgttggcgatacaggcggcaaggtagctttttcccgtccccacgcctccccaaaacaggtagccgatattttcagcctgcatggtttcccagctatccacataaaagcgggcggtttcggtctgcgggtttctgccgttgtcatgctcaaatgtccagttccgcatagcggggtcggtaaagccccggcgtttcaagtcctccactttttcaaggtgcttctgtcgactttcagcggcttcccgtttttcacgggctgcccggtggcagtcgcactctgccgggtgtcggtcatgccctaaccattgggcggtttcttttggaaagtatgcttcttttggcgtatggcacttgccgcagtataaaagcccgtcctcgcctgtgtagtcctccgcttcggaggtagtgggtgtaatgtccgtaatcatagcttcaatctcgtttttcataagctctcgccctccttgcaagaataatcgggtatgccctgttttggggcagccttgccttttgcagcgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggtggggtgtcccgtttctccctctctctctttttctatctctatctctttctctaactctatctctatctctggtggacgaatgtcggacaaatgtccgccttttgtccggggcggtaaaagtgccttgttttccagccttgcagcccgttttcgctcggcttcgctagaggactgtcctatcatcaactcaatgtcggtcatatagaaagccccgctgtcaagctgctccacaagccccaactgccggaaaatctccaaagccctctcaaccgttcctatctggtggcgggtcagtgtcgctatcatctgcgctgtgtaggggatatgctcgtcaagctgcaatttcccgccgtttttcagcgattttaagtacagcttcaagaggatattggagtataaaatcccgtctttcatatcttccagcagcacaatggagtcgctgtcaaaaaagttctctttcagcttgaggtagtaatatttgcggttatctgccattgaccctgtcctcctttttccggcgtttggagtagtagcgggggcagagtatgataaccgcccggaagctctgcttgcagctatgggtacagccccggcagaggtcgttgtatgtgatacggtcgcaggtggtattcccgactttcacttgccgcaggaaaaaagaccattccagccgccgtttcttgctcattcttggcataggtgcgctcctttctgccgtttccgctggtgtggcggtatcggcggtaattctgtatcatctcggtatcattttcggggtttttctgccctgtaagcccgttaaaaaatcctttggtattgcggataaggtacggggcagcccccttgttctgtatgggttcgggtacattttgggggcggtttttatcgctcctgttcctgctttttcacaggcttgcgctcccggcgtaaaatctggtcgatattgcccttgacagtctgtaagcggcggtattcctcccgttttgcccggtaatcgttgtagccgctgtttttctctttgataaggctttcaatctctgcttgcagggctttatagctcggcagcttggaaatgccgttctccctgaaatagcgggcggctgcgtctgctatgataaagtcgctttcgtgcttctgtcggtagactgcttttgctttggcgtttttctgctgtttcagcccgtcccggacagggcgggtcttggaataggcaagcacctgccgttgcagctcctttttcccgttcagcgtcttttccatctgcttcagctctgtaaggctttcccgcatggcggtataggcggcagaacaggcttcgtccagttcctccggggaagaaaagccgtactgctgataggcggtaacggtagctgccatttgctttaggttgtgctttgccgcccagcggtcatagcccacgcccttgccctcggcttgcttggcttcccggtcaaccatgcgctgcaaggtgttgtctgccggggtggtttttgcggctttttcctcccgcaagcgtcccttttgggtgtgggggtattcgggtatggctttggtctgctcggcggctttgtgggcgttctgcgtgagcagggcaaggacagcagccttgtcaaaatcgtcccccagcttccgggctgtgataggctttgtcctgtccggcgtgaggtaggaaagccgcccccggctctccttgacggtcacaccctcccgcagcaaaagggaagaaaattcgtcaaagctgccagcttgggaaagtgcctgccgtatcgtccggcgcagcttcgccttgtccgtttcaaacttggtgggcttggtcggctgtcctgcggcttctctgacagcgttctctttatcaagggcaagctgtcctttctttgccgcccagtattcccgttcggttatccgttccttgctgccgcttaggaggtcgatttggtaaagcccctcccggtggcacatctccatgacttcactcttgaaatattccatagcggcgttggtgcagcggtgcttgcagccctcccgtgtgtcggctggtctgtccatgtagggcagaagcgggacttcataaatccgcagggagttgatgacgatatgcacatggatattgccgctgtggttatgcccgtccgggtgggtgcagactaaggcttggtgtccggggaaatgctctttacagaactgctcgcccagctcctgcgcccggtctacggtcaagccgttgtctgtcccgtcccgtgggtcaaagctgatgatatagtggtggcttttcacatcttcccgtttttggtttttctcatagcggagattagcccgcatacaggcaacagcgaaatcctcgcccccacagttgagggaagaaatgcggtaatcctccctcggtatcagccgcccgttttcatcaagggtgggcttcatggtaaactcgtcatgctcaaatgtgagataggcttccgctgcgccatagtccgcatttttagagctgatatgtttgaatgttgccaacagcgtcacccactttctgcaagacttcaaactttagggcagcaaggtcggaaaccgccgcccgtacctccccggcaagctgcgggtaggggctgtgccactcgttcagcgtccgggctatctggtttaagttgccgccgatcctgccgtattcggcggtcagcttcccgacagcggcaagcaactcgtcattgacgggggaaacggttatgatggggcgtatggctgccccggttatggcttgccggataaactcggcttggctcatgttgtaagcagaaagcctttccgcaaactcggcgtattcttcctcggtcatgcgtgtcttgactacccggctgcggtgcggcgtgttatatcgttttcgcatggtaaaacctccttcggctgtgcgtggtgtcctctcactaataggagaaaaacagggtgtaaagcggaactgtttttgaaaaatccgaaaaattattttgagggattttccagcggcgtaagccgcataagcagggtttggggaaggcactccccaacaagattcccgcaggggcaaaatgagcgataagcgaattttggtactgcggtagaatcttgctctgaaaaactccggcgttccccggcttccgtactttccgctaacaagacgtttcaaaagggctttgctacccgctattccggcatatcttgaaaattttcctttcactacctacaacaccacgcaaagcaaaatggacggagatttttagaatttccccttattccctacaacaccacgcaagccgaaaaaggcggacaatggcagtatttttttctttgataccctccacggataagtaagggattttgccaactgcggcggcaattttcccttttgttttttcatactggggattttcaaaaatgccaaacaggaacgaaaaaaagcagcaaatctgttgaatagatttactgctttctggttgccggcgaagcggcggttattcagttgtaggcggtagggctatctcccaaagcggaacttgaaaatagctgtgagaagcgtctgggtgatgtagtcctctgtatcttggtctacccgtccattcacacgggcggcacattgtatgcggcggcggtaatactgcaatacagttcccaccgcttccggctccccgctggtggcttggacgattgtttcataggggagaagcctattatttctcatatgccattccctccatttccgcttggagctgccgtaggacttttcggatatggtagcccgctgtgctgcggctgcgcccgtactgtctgccaatttcgtgctgtggaatacgcttgaaaaaggacaggtaaatcatttcccgctcccgttcgtccagccgtgacagggcttccgcaagtaagccgctgctgaaaatgaccgtatcgccgcaaagggtaagtatgtattcctcgtccggctccggggcttggaaatattcatctgtcgtgcctaaagggtagtgcttttcgtctgtgaggtattcaagggatatttctcttttgtgcttcctgctccgtgtcctcgctgcgttgatcgttgcatttcggataacgactttgcaaaaggcatggaaagtgtactcgatatgttcccgatattcttctgtacaggtcatggaaaatccccctttcctcccaaaagggctgtggctggttagtagttgctttttatgatagtaaggggcggcagcactttaggctgtcgctccttgactgcctaactgcaaaaccgggcggggctgtcaacggcgggcgaagcccgttcatcttgaccgttgactggctcggccaggtttgctatttatccggcaaacttgaatttattttaagctatcacgttttacctttttaagccttactatcattaccataggaatttctttgttgtttttgaaacattcttcataaaatccatcaatgacaaatccagctctaaaacaaaggttaaaaatatcttgtatggaacgatgataataaatctgctcctccggttgcccttcaatcgctataccatagtaactgtgcggtgtcatatatttttcagtcaacgtgataaaacaagggtgttgcgttgcaaagacaaaaattccgctttcctccaacagttcataaacagccataagaagtggttcaatatccgtaatatccataattgccatattagaaactgctttcgtaaaggctcgatttctttttaattctaatatactttctctattggtcgcatccgctacacaaaattcaatttgttttgcatattgtgattgccgtcttttagccaattctatcatttttttgctgtaatcaaaagcgacaatcgaagcgcctctttgtgcaagatacgaagaataatttccattgccacacgcaatatccaaaatgtaatccgcaggattaggagatagaagttccgttactttgggacgcactacctctctgtgaaattcattagatttgtcacccattgcattatcccaaaattgtgcgtttttctcccagatttttttactttcctctgttcccatgttctctcccactcccaaaatttgcctttttgcttccattaaatcttccttactatattccattgttaccctccataacttctgattgttgccgtcttgactattatgtatcttttctttccaaaatggtataggcttttatttttataatgctgcaaaacttttcttctgtaaggtattcaaaggatatttccctttgccgccgctattggaaagccaaaagcagcggcttttttacgcgatatgaccgaaaagtctagaaagcaggatatgtcatcatttgtcatttcttctcaatgtaataactgcatggcatatcaagccaaatacaagagaaaaacagccaccgccaaatagtgatgctccccaccctgcacccgacattgtcataaaaccgccaacaaagaaaataccaatgccaagaaatatcccgacaccataaaaaagtccaattgccatatcatacttattaaattgtcgtttctcttttttttcacatgtttccatttttgttattacctccttcgcaaaatcgtccatgtggactccaaaaagaaaacaaatttttttcaacgtatttaaatcgggttcattaacatctctctcccaattcgatagcgcctgccgggtaacattcaattccccagccagttcttcctgtgtcattcccgattgtgttcgcagatgacgtatttgctttcctgttgtaatatccgtctgtttctggttcaaaatggttcctcctctctgatgctgattttatcaatatacgatacatttatgcagacaacaccacggatcggcttttggctggacaattccaatcaaacaccacagcagacagcagaaaccattctgaacaccaggaagccggtatgattgttacatataaggggaagaaaaatttcttttaagtacttgctttcctaaaactgatgtgatataatagcttcattccagaaaaggagtaaaaaatatgcggcaaggtattcttaaataaaactataatcaaatagtgggaacaaagaattatgatagctccttttgtgggggcttggttttttgtacccaatttaagaatacttttgccttatcaattttgacatattcaaaaaacagcaatcacaaataggtgtatgctgtatatgtgtatgtccgcaaattagaatccccagtggtaaaagtattttactgctggggatttttatgccctttggggctgtaaagggaggacaatcacatgaaaataatcaatatcggcattctggcccatgtagacgcaggaaaaactacattgacagaaagtctgctatacaccagtggagcgattgcggaacagggaaacgtggataaagggaccacaagaacagacactatgattttggaacggcaacggggaattaccattcagacagcggttacttctttttattggaatgattataaaatcaatatcgtggacactcccggtcatatggattttttaaccgaagcataccgctctttatctgtccttgacggagctgttttagtcatttcagcaaaagacggcgtacaggcacaaacccgtatattattccatgcgcttcagaaaatggacattccgacaattatctttataaataagatagaccaaaatgggatcgacctgcagtgtgtttaccaaagcattaaagataaacttaccagtgatatgattgtcatgcaggaggtttccctgtcgccaaagataaccatgaccgatatttctgatttagacaaatgggatatgattatttccggaagcgatgaactattagaacgatatgttgcagaggattctttggatatacaggaattacaatatgaaaagtgcaaaagaaccagatgctgctctttgtttcctgtttatcatgggagtgcaaaagacaatttaggaacagaaaaactgattgaagcgattatagaaactttcattacagaaacggacgatattcagtctgaattatgtggatatgtttttaaggttgagtatacagagcggaaaaaacggctttcttatttacgcctgtatcatgggacgctccatttacgggataccctgctgctgtcaaaaaaggaaaaaataaagattacagaaatgtgtattccgtcaaacggtgaaatcgtcccggctgaccatgcctgtccgggagaaattgttattttagctgatgatactttgaaactgaacgatatcctgggaaatgaaaaactcctgcctcacaaaacacggattgataatcccatgccattacttcggacaacggtagagccgcaaaagccggagcaaagggaagccctgttaaatgccctcgcagagattgctgatacagaccctcttttgcattttgacattgatactgttacccatgagattatgttatcttttttggggaatgtgcagatggaagtcatttgtgccatccttgaggaaaaatatcatgtggaggcagaaataaaagagcctactgttatatatatggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggagaatgtaacttcatgtttgctaaaaattcaaaggcatattctgtctacctgctgttccgatttgtctgttccctggcggtttctatgtccacagtgctttccatcgtgtaccacctggaggtggtgcagctggatgctttccagcttgtcctggtagggacggttcaggagacctcctgctttctgttcgagatgcccaccggtgtggtggcggatttgtatagccgtcggcgctcggtgctgattggaatgttcctctacggcctgggctttctgatggagggtgcgctaccgtggttcgcgccggttctgctggcccaggttgtctggggttgcggtgataccttcatcaccggcgctctggaggcgtggattgcctcggaggaagaggacaaacccatagacaaggtgttcctgcggggcagtcaaatggggcaaatcggcggcgttctgggcgtggtgctgggcacactgctgggaaacataaacctgcaaatgcctgtcatcttggggggcagtttgtgcttgttgttggggctggtgatggttcgcatcatgccagaaaccaacttctcccctgctattgaggaacggcagggcttgcttaaagactttgtctgcctgttcaagctcaacctgggctttgtgaaaggcgcacctgtgttgctggcgctcttagcaatcacactatgcgggggacttgccagtgaaggctttgaccggctctccaccgctcattttctggatgacacggtaatacccgttatcgggccgctgaacagcgtcacttggttcggtgttatcagtcttatcggcaacggcttaggtattctggcttctcagttgctcatcgcccgcatggagaaaaaagggactgtcagccgaaccagtgtggtcatgtccaccagcgccgggtatatcctgtgcctggttctcttcgcggtggggcggagcttttggttcatgttgttggtgttcctgctggcggggcttatgcgcaccatcaaggagcctgtgctggccgcctggatgaacgaccaggtggatgagaaaatgcgcgccacagtcttttccaccagcggacagctggactctttcgggcagatcatcggcgggcctattgtggggctggtagcccagcaggtgtccataccctgggggctggtctgtaccgctttcctgctgttgcccgcgctgttcttagtgccggtggcgggaaagaagcgggattgatatggcatagttaagtttactgacgagcgggagattacttccgctcgtcttcatttagtagcgcaaaatttgaggactctttatttccttattcggtatagcggaggcggctgtcaattcgacataattttcttgtgatactttaccgtacatgagcattagcccccggattgtcatttccgtagccctcaagcagattgattacgccccagataccaagtccggctcccagtgcgataacaagggtctgcaatacatcaactgcgctgttaaaaaactccataaagttctcctttcctgccgcgtctgcggctgcccgaaaaagggcataaaaaacggcggtcagttttgataactgccgcggtcataagccgccgggttccggcggttccccgcgccgcctgtatgtctgcggcgcagcggtattcagttgtgagtacaagcgtagggaacatgggtttttcagtgggggcgcgtatcatgtaaccaatcgttatgttgttagctgctgtgattcctcctttcttccattccggcgttcacaatggcgcaggacagcttcagcaaactgccgcgtgctttcctcgatacataaccgccagtattcccgcttaatttctaaaatcgcttctgccagccggatagaaagctgttcgattgcttcctcctgcgtcaaccgctgtttccgttttttcttcttgattcgtcggttcatggtctggttttcctttcataaaattgctcaaacagtttgacaagctcctgcatttcccgccgcttccgttcatctgcaagggaaatgacgctgctcctgcggtctgggggctttgccactgtgcgcttatccattccccgcgtccccctgcaaatcggcttcgctgatttcgtaacagtcaaagggttcctccggcttgacgattgcggggcggcgtttcatgtaacgctcaatatcaaaggcatttttcttgtcatagtcggaaagatatttgtacttcgggtgtttcgttatatcgtacttatccgaaaagaacgggcgcacaccccgtagctgcaagatacatttccctccgtccatgacggcgatttcgtcctgcgtcattaactctttccctaacttctggtagttcagcccatgcgacagctcccgtcctctggtttcggacgtattaaagctgtcaatggtttctttccccaacagctccgacatttctttcagcgtggtcttttccttgccgcccaagaaaagggtcgtgtcgcagttgccgacaatcgtatcggcgttgtccttatagattgcctttagctgtgactggctttgcagaatgatagaagccgatatttcccggcttcggatagtggcaatcagcttttcaaacttcggtatctgtccaatgttcgcaaactcgtcaagcaggcagcgcacatggacgggcagccgcccgccgtactcgtcgtcggctttatcgcataacaggttgaaaagctgcgtgtaaaggattgacacgacaaagttaaaggtgtcgtccgtatcggaaatgataacgaacagagccgttttccggtcgcctatggtgtcaagctccatttcgtcggtttccagaagctcccgcagctcccgtatgtcaaagggggcaagccgcgccccgcaggaaatgaggattgaggaacgtgtcttgcctgccgataacaggaatttcttatactgtcttacggcaaagtgttccgggtctttttcttccagacgttcaaacatgaggtcaacgggggactgaaattccgggtcgtcctcacgggcttcgcttgcgttaatcatttcaagcagcgtggtaaagttcttctcgtcctccggggcttcataccagatatagccgataagggcgcagtaaaagagccgttccgacttaacccagaaatcctccccggatttttccccgtcgcctttggtgttggcgattatggtatttaccagtttcagaatatccttttcgctgcggatataggcgaatgggttatagtgcatggacttcttaaagtttatggtgttcagcacttttatcttgtacccgccgcgctgcaagagcttcccgcactcgactaatacggttcctttcgggtcagtgacaacgtaggagctgtgcatttgcattaagttcggctttacgaaaaatcgggtcttgccggaaccggagccgccaatgacaaggatatttttgttccttgcgtacttcggctgcttcgggcggctgctcatcatcagccgttccgtctgggtcagcagcacgttattttcaaataccgggtcgatatagggctttatatcctcggcgttcccccaacgggcagagccgtactctatgcccttgcggtacttcttcgcgttcttgcccttgaagtagacaatcagccggataagcaccgcccccgccgcgcccatgagtaaatccatagggtgtaggctcggcgcggcacttgaaaaggcagcggaaaagcccgtcccaagagagagcagcttttcggaaaggtcagcccctggcgataagcggaacgcctgcgccgccttgtcaaagagccagacaaagagcaggtacgggagatttggaagtatcagctttttaaagtttacgctgctcaacggtcaatccccctttcctttttcttcgtctgctccctccccgcgttaagctgctttgctttctcccggaaaacggctaacgccttgcggatagagggctttttctcttttgagagcttctttgcggaaaactccttaaaagctgcggtcagcgcgtcggcgtcccggcttttgaagaacacaaggtaacggggcggggtttccgtcgcgtcctttttcagcgcaaagtcaatcccgtatttcttcgccgtaccctcaaaggctttgatattgtcctttgtgatttcaatgttggaaacgcccgcgttctgcttcataagctgctttaaggtctgcttcccatgcggcatttgccgtttgtctgcctgctttttgagctgtgcaagaaaaaacttcatggacttttgcagcacttccgcagacagcttcccggtcttgatagacagggcaaccactttttcgttgatttcatcttgcatttatcgtcctcctttcgcggtttttagggtggtacgccgcttcggggcaggaaaaaagggcgtccgttctctgcgtcgcccttaaatccgtacccgcagcccgttcaagtcctcggcgcggacacccaccagataccagttctgtccgtactcgatacgggtcggcttccatttgccccttacgaatacttccagacagtcgccacaatgcaagcccccatagtaggcgttgaggtcaaaacgaatgtcgtaacggtcggtcagttcgtcaaataccaatgctccggttctctgtgccataaaaaaatcctcctttttctgtttacaggctttcgccctcgttgcaggaataatagtccgggtcgccgtactgtggctgtttcggggcaagtgcgccctttgccatgtcgtgggcgacaagggaagtatagtaattgccgatagtggacggggcattgaaaagcaccgcccgtaagtattgcttgatgttgcggatttttgttgtattctcccgcatacagtcaagggcaaagcggatatgttcgctgtccagtttcataaactttgacttcacaagctccgccggatagtcgtccccggcgatacggattgtctttctccttgtgcataccgtttcaaggataaggtcaaccacttcgtctaagcggtcgtggtcgtagggcatatcctgtttgagaatgtcatagctgatgttgtccttgatgatttcctcatacacccggtatgcgtcattcgcttcctttcgcttccgttccggcggcgcagccgcttgtccctctaagggagaggggttaggggagtggaaaggaaaggaatgggtacttgataaatccgtatttgatttttcttttgttggtaagttagtctttggtatatttttatttaattgcgttggattttccgacgccggattatccgttgtcggattttccaataccgggttgcccgctgttggattttccaatatcgggttttccaatcccggcggctgcggctgctcgtaaatggtgtactcgatagcggtcattttgcctttctcgtcgcgcccctgccgccttgtgatatatccggctttttcaagctcccatacggcggtacggattgcgtcgatactttcccggttgatataggacagccccgcaagggtatagtcccaatcttcgggaagcgacagcatttgagagagcagcccttttgcttttagggtcagctccttgtttcgtaagtggtggttgctcattacggtgtagccagtgttgcgttccactctgaaaactgccatagtgtttcagctcctttgctgtggatttgttacgcagtagaacggggattttgagggaaaaggtatctttcccttgccccgtcagttccccgttctggaagccgcataaatcaaggctttttttgcccctactgcgtaacatgagggcataaaaatagcggcgttcctgttttcccggtgtgggagtgagaaacgccgcttgtgcggttcaatattctgtgttagattgccatatagtcttatccgtaacaatttttaatgtgcctatcatgtagaaattatgcgttggactctgattttaatatattgatttacacccatttctacacccaaatggcatgaaactatatgattttatgtgcttctttataaagttgcgattttgagaaatgcagcaaccatgcggttttacggacttttatagaggtacatggatttatgaaaaaaggctaatttattacggatccaagtttcatttcatttctctccattctctttgtaaatttcttactcgtcttttgtttccatcaaaatgagtgtcccggatgagaaggtgatgacaagctcatcctcctcgatctcgttgctgacacacagactgtcattcgggagcagatgatgatgatccagcggatatttcgcgcccacaagcgtcaggttctccacctctcccccaaacgggaacagggaaaaatacttcccaaatgcctctcttcttttcaaacgaacttccccgtcgcagagtcggattctgttgcatgtatcccgtatctccgcatggactcccgcctttctcgcaatctccaaggactggacattggcccagatatgatcgatccggctcccggtagcgccaagaatgatcatctgatcacatccaagggcaagcgccgtccggatggcaatctccgtgtctgaagcgtccttgaccggattgtattcccggatcggaactttcgtctcctcccggtaatagcggatgacctcctcggagatactgtcaaaatctcctacaatatattccggaaggatctggtgccgatataagaattcgactcccttgtctactccgataatacgttttgattcgtaagattccagaacggaaagggcaaaatcatcctcgatcgcccccccgctgatgatgattgtcactctactcatattgttttaatctctccatcataacccttgtgttctctcccggatttcccccaaatacagcggaaccggccacgattacatttgcccctgctttcaggacttcctctacgttctcctgataaatgcccccgtccacttccagatcgatggtctgtccgctcttctcgatcatgtcccgtactttccgaatcttttccagggactccacaataaacttctgcccgccaaatcccggctggacggacatgacaagaatcatatctgtcagatccatatatggcaggagctcctccgcctccgtctgaggacagatggaaagccctgtcttttttccacaggctttaatctcccgaagcgtatttcccacatcagaacacgcttccaggtggacggtgatgatatctgctccggcctgtgcaaagtcttttacatagcggattggttcctgcaccatcagatgcacatccatcacctgatttgtggcacctttgatagactttaacaccggcactccaaacgaaatgctcggcacaaacatgccgtccatcacatcaaaatgcagatactttgccccgttttcctctgtctgcttcatctgttctgcaagacattgaaaatctgccgccagaagagacggcgccaaaatatagttcatacttttcctcctcaatatcgctgtttctgttccagttcacggtacagttccagatagttttcatatctgctcttcgggatcttccctgtctccagggcatccttaacgccgcatcccggttcgtgaatatgactgcacccctgaaacttgcagttcccctcatacggctcaaattcccgaaaataatatttcagatcttctttttcaaagtcattgacatacagagagccgaatcccggcgtgtccatgatgtacgtctccccgccgatggcaaagagctcagagtgccttgtcgtatgccgtccccgctcgatctttctgctgatctccccggtctccatattggcgcccggttccagaagattgatcagagaagacttccctactccagatggtcctgcaagagcggttgtctttccctctaaaatcctgcggatcttggtgatgttttcctccttcagggcacttgtaaatacaaccggatagccgcaggtctcatagacctcctttaaccccctccactcttcatccgctgccagatcttttttattgaagcagagtgttaccggaatgtctttgctctccatcatgatcagaaaccggtccagtagattcagatgcggctttggctttgtcaccgcaaacacgatgagcgcctgatcgatattggctaccgcgggacggatgagctcgttctttctcggacagatcctcacaatattcccggtcttttctttctcatcgatcacatccatctccacgttatcgcctaccaatggtttgatcttttccttgcggaaaattccttttgccttacattcataaacaccggattctactacgtgaacgtagtagaatccggcaattcctttcacaatctttcccagcatgaaagtctccttgtgtgttttctgtcgtcatccttcttctagctgatgctgacatagaaagtgtagcttccgtcagaattctcctcgtaccggatgactccgccgtgtggtacggaagtatctttctcgtactcaacattgtatttaacgcccttctccttcgcccaggcatcaatattactttcccatttcgggccgtctgtagatgaggaaccggaatcatctccattctccttatcgtcagtattgttattattgttgccgccgctattattactgtcgctgttattatcgttgtcagacggcttatcctgatccggatcttttccaaggcttaccacatagctgatcgttgtatccttggagatctcaccggaagtcagagactgggaaataattcttccctcgttcacctcatcactataatcctcagagcgggaaacattgatcccattctcctttgcccaggaagtcaggctgctttccggcattccgacaaaactttgcacagtcaccttttcgtcttccggatcgatccccttgctgacaacaaggttgactgtagatccctcctcgacctctttcccggaagacggagtagtccgaatgacttcgccctcatcgtattcatcgctgtactcttctgttgtggagccggctttcagaccttctgcttcaatcttttctgttgccgtgctgatatcatcacctgttacatccggcacggtcacggtggacggtccttcacttaatactacagaaatggtagctcctcttttcgcttcctctccgtatttcggatcctgatcgatcacagtgccctcctcctggtcggacttcttcgtaccggaaacttccagcttaaatccggccttctcagcagcttctcttgcctgctcttctgtcagcccgagattggagagattcggaactttctcttttcgctcttcctctgtctttttggagtcgcctccgaacagaccgacagcgtttccgatcccgtatccggccgcgcaaacaaccagtaccgcaatcagaatgattaccatcttcatcacaccgctcattttcggcttcggtccatcgtccccgcggttttgccggctcttcacgcttcttgtatcataatcatcctcgtcataccggtcattatagtcatcttcataatgttcatcatactggtcgtcgtagtcgtcctcgtattcctcatcgtcatactcatcatcgtactgattctgaatctttctgcggtccgcctctgagatcatcacggtatccgctccgacaccataagctgacgcgccgttctttacgaaatctccgtttggatcggagagagatcttcttaaatcctgcgccagcagtgtcacattcggatatctgagatccgcatttttctgggtacatttcaaaatgatctgctccagagagtacggcattggaacgtactctgacggcggcacgatctcctcctggagatgcttcatggcaatcgccacagttgagtctccatcaaacggcacccgtcccgttaccatctcgtacatggtgataccgatggaatagatatcactcttctcatcggaaaatccgccccttgcctgctccggtgatgtataatgcacggatcccatggcattggaacttgttgtattggaacttgcggctttggcaattccaaagtccgttaccttcacttttccttcgttggaaataataatattctgcggcttaatgtcacgatgaatgatgtgacctttatgtaccgcttccattccggcacatacctgcagcgtgatgctgatcacctcttttggcgacagcttctgttttttcgcaatatattctttcagcgtgatcccctcgaccagctccattaccatatagtaaagcccccggtccacacctacatcatagacattgacaatattcggattcataattccggctgcggcctgtgcctcggaccggaacttctttacatatgtttcatcttcccggtattcttttttcagtacttttacggcaacgtaacgattcagcacattgtcgcgtcctttgtaaacatcggccatcccgccggcgccgatcttactgaggatctcataccgctcccctaatacaataccatcttttaccatatactcacctcatctgcatacggctgcgccagtacaatgccaatattatcggagccgccgttctcatttgctctttgaatcagagtttctactgcttctacaatatcacgtgcgctttttacaatttgaaagatctcatcatcgtctaccatatttgtgaggccgtcactgcacatcagaatcgtgtctccgccttttaaacggtactcaaagaagtccggctccaccttgtctttgacacccatcgcacgtgtaataatgttcttatcaggatggtgctttgcctcctcctcagtcagtccgccaagcctgaccatttcttcaaccatggagtggtcttttgagagctggcggatctctttgttgatcagatagagtctgctgtctccaacgtttgcgaaataaagtacatgatccagaatggtggccgccacaagggtcgtccccattccctccagccggctgtcctttgccgcctcctccatcaaacgctcattggcagtctgaatcgcgtttccgagtatctgctcaggatgggtctctttgctgttctgaacctcttctgccagaacttccacagtaaatcgggacgcaaaatcccctgcgcgatgtccgcccattccgtcagctaccacaagaagattcggaagatttccgatcgtttcatccgtggcgaacacataatcctgattaatctctctttttctaccaatatcagtcattgaaaatgttttcattttcattctccttatgattgtctctgtgttttattctgagctgaccacaagccccgtcaatatcagagcccatttcccttcttatagtaacattaatcccatttttttcaagtttattttgaaaaaacagtgcagtttttttgtccggcctacggaaattcttctcccgcaccggattgaccggaatgagattgacatggcaattacggtgctttaaaagggatgtcagctccaggatatcctcttcggtatcgttcactccatgtacgagactatattcaaaggtgatgcgccgtcctgttttttcaaagtaggcgtcacacgcctccagcacttccgaaaggtcatatttgttggctaccggcatgagccttcgccgcttttcctggttagtcgcatggagggaaagcgccagggtaatctggaaattttcctccgccaaacgaaggatattcggaacaattccacaagtggacgccgtgatatttctctgactgatatgaagtccgtgttcatcactgatcatccgaataaaacgaacgaaattgtcgtaattgtcaagcggctcccccgttcccattacaacgatattggaaatccgctcgcccgtaatcttctgcacttcgtagacttcccggagcatctcagaagctgtgagatttctcaccagtccgccaatagtagaagcacagaaccgacagcccatccggcagcccacctgagaagagatgcagatgctgtttccatgtttataccgcatcagtacgctctcgatcatactgccgtcccacaattcaaaaaggaatttgttcgtaccgtcaatagacgaaatctgccgctccaccaggcggaccaacgcgatttcatattctctgtcaagcttctccctaagggttttggaaagatttgtcatctctccaaaactctctgccatcttcacatgaatccactcgtaaatctgcttcgcccggaaacctttctccccggaaagtttcatctcctcctccagttcccggaacgtataggaagcaatatctttttttttcatctattctgactcctgttttttcaaaactgctatgtaaaatccttcacacgggtcgattcccggaaggaactgcctttctttttccatcgtaaactcgccatggtcctccagaaaccatgccgtattctcctcgttttcctccctgttaatcgtacaggtgctgtaaaggagcgtaccgcccggtttcacgtacctgcaaacaacagacagaatctcccgctgcaatgcgacaagttccgcttgtttctccggcgtcatattgtaccggatatccttcttagaagcaagaaccccaagcccggaacacggcagatcagcaatgacgatatccgcctgttccacggacgcttcctccagaattctcgcatcctgccgccgtgcccggatattcgtaagaccacttcgcgcaatattctcttcgatgagttttaccttgtagtctgtcagatcccttgcgtccaccttcccggtgcccgcaagcttttccgccgcgtgaagcgccttccctcccggcgccgcacacacatcaatgatgtaatctccctgccggacctgcagactctccaccgccatcatggagctcgcgtcctgtacatagaagagcccatcctcaaaggtagaaagtgctcccagataatcataccccgaaatccataacgcatacggaagagccggatggtctttgatttttgccacaccatcctccttaagtcgtgcttttaacgtatctttagaaatccgttccgggtcaaaccggatacaggttggatgctcttccatcatactggcaatcattttctccaccgtctcctcctggtaaacggccatccacttctccaccatccatttcggaacggaatactgaacagatagctttgtcgccggcggctcctgaggaagacgaatatgctccaactcccttgcaatcgttcgaagcactccgtttataaatccggacaaaccttgcaagcccttcttttttgccagttttacagcctcgttgcagacagccgatgccggcacatgatccagatagcggagctgataaactccgcttcgcaaaatggcaagcaccaccggtttcattttctgtatctttatctttgaaaactggtcaatgatataatcgatctcaatcatatgttccagcgttccctccgtcactttcgtgatgaaagcacgctctcttttatcaaggtactgatacttgccaagcactctcgagagagccagatgagccgggatcttgtcccgcgtcacctccagcaagatggcaagcaccagttcccgttccccgattgttttactcacgccgccttcctcctgtcagtaaaataatacgaagcaactgcaaaatcgccgaagcggctcccgccacataagtaagtgccgcggcacctaatacttttctcgtcatggagagctcgtccgccgatagaatcccactctctcccagaatccgcaccgcccggtttgaggcgttaaattccaccggaagggtaacgatctgaaagaggacggcaaaagaaaaggctataattccgatctgaatcagcatataagacgaacgactgttgaacagtaaaccaaatagaatcaaaggccacgcaatggctgacccaaaattcgcaatcggcacaatggcgctccggatacgaagcggtgcatatccttttgtatgctggatcgcatgtccacactcgtgtgccgccacacctaccgccgccacagatgccgattgataggtggcatccgatagacgcaaaaccttgctccttggatcatagtggtctgtcaggttccctcccacatgctccactctcacatcataaatccccgctccccggagaatcctttcagccgcctcctttccggtcatccccgacctgctccggacccgcgcatattttgcgtaggtggaccggactctggccgaggccagcacacaaaggatcagaccgatcagtacgagactgtacgtcggatcaaaataatagtaaaatggcatttctaccgctcccttcacctttcaaaatcagttctcccccagaatcaatccttctttcagcgaatacccccgcagaaacgctccggcgtccatccgctttttccccggaatctgaagctcacggattgtgagactcccttctcctgttttcactgtaaactcctgctttgacacggaggtgatggtaccgggctttgcctcttcgcttcccggcacatctcctgccacatccgcgtcccagattttcattgtctttttgtcccaagtagtatatgcacttggccatggatttaaaccacgaatcagacgttcaatcgaaaccgcgtcccggttccagtcaatccgccccagtgccttgtcaagcattttcgcatatacggtcgggctttcgctctgcttttccggccggatacttccctcttccattctccgtaatgtctcgacacagagcttggcccctgcatcggccagcttgtcgtggaggcttcctccggtctcctttttatctagttcaatcactgtctttaagagcatatccccggtatcgagcccttcgtccatctgcatggtcgtcacgccgctttccctttctccgtcaatcacagcccactgaatcggcgccgcgccccggtatttggggagcagtgaagcatggacattgacacatccataaggcgtcatctccagaatctcttttggcagaatctgcccaaaggcaacgacaaccataatgtccgcctgataggatctcagcttttccacacactcgtctttgcggatccgctttggctggtagacctcaacgccatagcgcagagccgcttcctttaccggtggaaactgcatttcctttcctctgcccttgggcttgtccggctgtgttaccgcaaggacaacctcatgcccagcctcaatcagcgcttccagcgtccccacagaaaaatccggtgttcccataaaaatgactttcatactctgtcacaatcctttctactcttcttccacattatcatggattccatcttccgcaagtctcatatacatctgtccggaaagatgatcaatctcgtggcagaatgctctggcaagtagaccttccccctcccagatgacctcttccatttcctcattaagtgcacggacttttacgtggcttggtcttgtcacaatcccgtatttccccggaaggcttaagcatccctcttctccggtctgggtcccatctgactcgatgatttccgggttaatcagaacgatcggtccttctcccacatcgattgtaacgatctgctttaagatacctacctgtggcgccgcaaggcctacacccattgcgtcgtacatcgtatccagcatatcttgaatcaggatcttggtccgaattgtcattttatccacctttttgcactgcttttccagtacttcatctcctacttcacgtatttttctgattgccatgattattccctctctttactattaaaatgcctggaccggatcaaagtcaaattgaatccggatcctggaaaatccttcattgatttcaatatattgctctattttattcttgaccgcgatcagcacctggtaatcttcatgcttcagataaagcgctttccggtacaaatcccggatctttgcgaccgcagggcttgccggtccgataagctcaagctttggatcggaaccgaccgctttagcaaaaatcttcagatagtaggctcctttttccaggagcgcctcatcctcgcttatcatcaaaattgccattaaatgtgctgagggcggatatcccatcagggagcggaacttcatctcctgctcaaagaaggcctcgtagtcctgtcttgcggctgtctgaatactgtaatgctccggatgatagctctggatgactgcctccccgggaacactcccacgtccggcacgccccgctgcctgacaaagcagggcaaatgtccgctccgccgcccggaaatcactcatatacaaagacaaatccgccgccagcacccctaccagggtgacattcggaaaatcatggcccttgacgatcatctgagtcccgaccaggatatccgcctcctgatccgcaaaagcagaaagaatcttttcgtagctctccttctcccttgtcgtatccagatccatccgaagtacccctgcctgcggaaattcttttttgatcagctcttccacctgctgtgtcccggccttaaatgccccgatatggggggaaccgcaggacgggcagaccgaaatcaccttttcctcgtaaccgcagtaatgacataccatcctgccgcccttgtgccaggataatgatacgtcgcaatgaggacattttactacatatccacaggacctgcaagacaggaaccccgcaaatcctctccggttcaaaaagagcataatctgttctttcttttccagacggtcgtaaatctttccccgcaaggcatcacttataatagaacgatttccatttttcagctcgtctcgcatatctacgaccgatacttgtgccatctgctgctcttttgccctttttgtcaggcgcagcagtcggtatgtgccctttttgcaccctgcaaaagcctccaaagacggggtcgcggatccaagcacaacacttgccccctcgatccttgcccgctcgatggcggtctctctggcatgataccgcggaacctgctcacttttgtaagtcgcctcgtgctcctcatccataacaatcagccccaaatgctcaaatggtgtaaacagcgccgatctgggaccgatcatcacatcgatttccccggatctcgcccgcatcatctggtcatagcgttccccggccgagagtctggaattcataatcgacacccggttaccaaatacttgcacaaatcgcatcacggtctggtaagtcagggcaatctccggtataaggacaatcgcctgtctgccggcagataccacggtacggatcatttccatatagacttccgtcttgccgcttccggtcacaccgtagagcagataggtatcaaaccgggctctttcatagtcctcctggaagatccgtatggcttcctgctgctcctccgtataagttatccgcgcccgtccggcgccggatgcccgcaccggattacgaaataccgtttcccgctccactgtaaggatcttcttttcttccagggcacgtacgacctgagctgttacgccaagctttctcgtaatccatccataatctacatcctcgctcttcaaaagcacttccagaagccttgcccttgccttctggttcttcctttggaagaaagacagccactttcttccctcctccacagaaaccgtcctgtgaatcatccgcttctccttgggccgctcctccttcttcactggccagaccgtctttaatgcctgaatcatcgtcccgccatagtgctctttcatccagacggcaagggaaaccagattctcctcaatactgacgctttttggcgctttgccgtgaatggccttgatcttctccggatcaaaactacattctttggcaaagccgacaacaaacccctgacgcagccggtcctggtttccaaacggtaccagcacgctgcttccgatggccaatccatcctccatgtcttttggtacctcgtattcaaaggtccggtccagtttttcatgtgtgatatctataataatttttgcgtacatgcttcctctactaattcctgttcatccatatgatacaatcttccctgaatttcctgggttgtttcgtgacctttgcctgcgatcactaccagatcaccaggacctgccatctgcactgcccgaaagaccgcttccctgcggtccacaattcggagatacgccccgcccgtctttcgtactcccgtttcgatatcatttataatcgtctcaggatcctcccatcttggattatccgaagtgagaatcgtaagatcagaaagccttccggacacctcgcccatctgaaatcgcctctccctcgcccgctgtccaccgcatccaaacactgtgatcaaccgagtcggatggtagccctttagagtttccaaagcactctgcagactcatagcattgtgagcataatcgatcactgcctctgctcctcccggaatgtggaggaactgcatccgtccccggacctgaaagtctgcaagtgaggctgatgccgtttcccacggtacgtggcacctggcacaaactgccattgccgccagagcattatacaccgtaaaacgtcccggtgccggaatggcgacatggactttgcagacgtcaaactctacccccggatgcccctgcacgaatccctcggcctgaatgtgttccgcccggatctctccctgccggatgccaaacgtcccatacgggcaccccgtacccgaaaagatccgctctgtggccggatcatccccgtttcccaaaccttcccggctctgaagaaacagtttcctcttacacgccagatattcctcccggctggcatgttcgagctttccaatatgatcctctccaaggtttaaaaagacaccgagatcaaagcagatcccacaggtccgtttaagcttgagcgcctgagaagaaacttccatcacacagactcgacagccattttggcgcatccgtccaagaagcctctgcaacgtgacggcatccggcgtcgtatgctctgcctgttcttttcgtactccgtcaaactgaccgaccgtgccgatcattcctgtacgtatcccaaaatcctccaggatcttccgaatcatgcacacggtggtcgtcttgcctttcgtaccggtcactccgatcatcgtcatcgtcttcgatggctccccttcgtatcttgcagcaagaagcgccgccgcttcccgttcgtcatctaccaggatcccttcgcactccgggaattctcccaaaatctctccgatcgtctcccgctcctcttttgcggccacaagaagcctcgctccacgccttagcgcctccctggcataccggctcccgttacagagacttcccctgatacaaacaaacaccgtaccctcccggcactctctggaatcgatacagatcccatgaatctcacgttccggaaagtgcatacacttagcaaacggttcatacgaaagcgcgcccaataattccgatactctcataagcctgcatactttctgacagttcttactatcaatataagtaatcatagcataattgttacttttagccaaccgtcatcttccccgtctccttgtctttttcatttccccgtgttatactggtggaacaaaaatgatatcatttggaggttgctatgttcaatatttttggatgcccgatgcactttggggttggtgcgccggggttaaaatacagtcttgattatttgcgaaaccgctatgaaaatttaagaattgtcaaattgcctgagattccgatggaggaggatccggattgtgtattgaagaaccgcaataccgtggccgctacctgtcagagcattgcccagtatatgtattcggtctttgaaaccgggaagatcccactgtttcttggcggggatcacagtgttgtcatgggttccgcctctgccaccagtgtctatatgcaggatcattttggcgaggataccggcctgatctatattgatgcccatgcggatatcaacacggacgccactaccgtgagcggaaatatccacggtgttccggtgtctgctctccttggcctgggagatgaaaagctcaccggatttctccgtccgggtgccaagttccacccggagaacatcgtctatcttggtcttcgtgatattgatccccctgaacttaccatcttaaaagagcaggggatccgttactatacttacgatgagatctgtgaacggagcctttctgtctgccttgaggagacggtatcgtatctctcccacctgcactacgttcacctaagctttgacattgattctatggatcctgccatcatgcctggagtatctgttccggtgaaagggggctttaccgaggcggaggtatacgagatgttcggtactctgatgaaaaagcttccgattgccgcctacgatatcgtagagtttaaccaggaatacgaccgtggaaaccggaccgctgacttcgtatccgaactggtgcatttcatcacaacctccgaccgaaaagatgcatgataatatagtcgtaaggaaagggtgccgcaagatgatctgtctgatcatccgcggcaccctgaactattttctccggcaagtgctttcgtgaatctggtcataactttccagatactttttcacatattctacatctgacggacagtcgatatactcgcttccatacttctgacgtgtctcattccccttgcctgtcacgagaatcacggtcctgtcttctgactcctcaatagctgtacggatcgcctctcccctgtcttcgatcatcacgtacggacagttctgtgcctgcacatactgtgcgatatctccggaaatctcctccaccggctcatagcccgggtcctctgccgccagatagactttctgtgcgtactgtccggcaatggtccccagatcctttctgcggatataggctttctttcccggacaaccaaagactgccttgatggcatagtccggatattcctcccggatggaggaaaacagcttctcaaagcttagtttattgtgggcatagtccacaatggcaatgatctttttatccttgcttgcgtagagttccatacggccgctggatctggctcttaaaagtcccgaatgaatacaggaatccggaatgtgcaggatcttagccgccgcgatcaccgccagtgcgttctctacattgaacaatcccggcatagtcagacaatagtcctcctccccctctttggagcgcacggaaaatttcgtctcatggccgtctttccggatttggtatgcatagtaatccgcattttcatctttctggctgatcgtcgtcacatcgccagccgcctgagctgcctccagaatccggtccgcaaaatccgcatccagattcaccaccgcatggtcggtctgtgcgaacatccgcatcttggatgtaaaataatcctcaaagtccggatgctcgatcgggctgatatgatcctccgagatattgaggaaaatcccaacatcaaagcgcatcccatcgacccggttatatttcagtgcctgactggaaacctccatctcggcaaatgtgatgccgcaatcggccgcattgcggaaatgccgctgcagctccacagcctccggcgtggtaatatgagactccactctgctcttcccgtcataaatatcaatcgaagaaataaccgcgctttccggctttcccgtctcctccatataatcgtccacgatggctttcatgtaatatgcggaagtcgatttccctttcgtgccgccgacccccacaaccgtcagctccttccacggagagccataaaaagcattggccagaatcgccatcgcctttcgtatatcactcacaagaagaaatggcacatcctttccggtctcgtacttcctttcactgatatagagtaccgcacccttttcaatcgcgcttactaaatatgtttccctaaaagccgcacctttacagataaacatagtattggctttcacttcacgtgaatcataggtcaatacatccggatgcgtctcctcctgtccgtaaagtgccgcctccatgagcaggccacttgcctccatcaaatctgcatatgttttcaaggtatcgcttttcctctgtgacatctgtcttctcctttactttattgatagcaggcgccggaccgtatgatagactcccggacaagaacgtccatagcgtccagacagatctccggaagcacatgatcctgtttaaaaacggaaatttccgtacacgccaggatcaccacatcacagtcctttttgatgaactcctccatcacccgctcaaatttgtgataatttccttttttcccggccttgacatcatcatagatcaaagacatcacatccctttgccgctgttcggacggtatgatctcctcaataccatgggactcacattctctgcggtaaatccccgcggacacggtgccgtcggttcccataatcccgattcttctgacattctcaaaatgctcttttgcgtatcgtaccgtctcgcgcggcatgtggatgatcggaatttctgtcattgcctgaatctggtcgtaaaaataatgcgatgtattacacgggatggcgatatgctctgctccggccgcctccataactttcagatccccctccatcgcctgcaaaagcggatcgcactccccgctttgaatcgcctttgtccggtccggcatggaggcatggcttaaaatcgtcatgtccagatgttcctgatcacaatccgccttcgtatgccggatcacttcctcgtaaaaatatgcggtagcctccgggcccatgccgccgataacccctaattttttcttcatagtccctccttacattctatcatgtccgccggtcaatgataatatttctgaaacttgatgaagtggctgaaatgcgtccgcatcatccggtacaatctcggaagtcctaagtcccctttcttaaagaccgggttgacgacctttccttcccggatcagcttcttcatctttgccttggactgtgcatcctttacatacttaaaagccaccgctttcgggacaaccatccagagatgctcctccttcgccgtctcaaagctcagctcttttccatagacgtattcctccacaatatacttcgccacattaaaaccggaaccggtcacatagtaattgcttcttccctgtctcgtattgatctcaaagaacttgtactttccatctcttctgtcaaacttgatatcaaaattggaaaatcccacatagtgcagatcttccagtaaatttcttaccctcttcatcagttcctgattcggttccgtgataatgaccgcatgatttccaaggccgtgcggcgtatgctcctcaagcagcacatgtcccaggcacatcatctttactttcccatttcggtctgagtaggaggtcaaaacccgcatgtactcatcgtttcccggaatcatatcctgaataatcagatcatcgtcatagcctgcatcgtagatctcccggatcacagaattcagctcctgtctggattggatcgtgtagactttcttctgggtgtcaaacggatgctcccagtacttgatactgtcagacggtttcaaaatcaccggatacggaaaatcaatggtaaaatccatggacattccattcttgaatacaaaagttccaggatagtcaacgccatgtttctcgcacagcttatagaatgtctccttctgctgcaaactgttcatcagatcaaaatcaatatatggggcgatgatgttgtcgtcaagctgatctttatgcttgctgatcagcgccacatagctgtctccacatccgatcagtatgatctttttatccttatgcttccttgcgaagctgtgaatggtctttaaaaagtaatcgtccgtatcaatcttcggattggcatgatattcaatcatccggctctgatagctcggtccggtcggatatttcccgaagatatatgtcctgacctggtactgctcataaaaagctctcgcaacactgtaagtattgatatccccgcccagcagaaccggtatgaattctcttgacacaaattccataatttcttcctcttttctcctgtttcacgtcgttttattatacccctcacagaaacggctgtcaaacgctatccctgatcttgtggatccttttcttctttcttctcctgttttttgagaaatgccgcacgcatgaccgcatcgtccccaaactttttgcggatctcatcgagcgcacggtcaagcttccggtgcctctgatcctgtttcctctcatttttcgtttcccgcacctcttccaggtaatcaaagagattcatctgctggggcgcgctctcctcttccagccgggaagcacgaatcccaaggagccgtatcggcgtcccgtcccagagttctccaaagagttcacatgctctctgatagagaatcgtgtctgactgggcagatggcgtcacctgcatctgatgggaaacattgcggaaagtagcgtaacggatctccacggtaatactccccgctttttttcctgcttttctcagccgcctgccgacactttgggcaagcatcaagaggactttttttgcctcctcttccgtcttcgcatcctcagacagggtggtggaattgccgatccctttcgcctcttctcctactgccttcacaatatcgtccccccggccgttggcaaactcccagagaagtctgccatggcttttcagatgaatctccagataatccggatctgaccgggccagttccccgatggtacggatctccagctttctcagcacttccacgcttgcccttcccgccatgtaaagctcagagatgtcaagcggccacatcttatccctgatctcctctggaaagagggtgtgcacccggtccggcttctgaaagtcggacgccatctttgccaacagcttattcgtagaaattccgatgttgaccgtaaaacctaattcctcccgaatccggtttttgatctcaaaggcagcgtcaacaggcgtggaaaagcggtgtgcgattcccgtaaaatccagaaagcactcatcaatactgagctgctcgatatccggagtatagctctttaacagttccatcagtcttttgctgtacctggcgtacatcttgtggtccggcggttccaaccgaagcatcggacattttctgaacgccgatacgaccggttctccggtgcggaccccgtatgctttcgcaggtatcgatttggcaagtacaactccatgtctggatttcttgtccccgccgataatacaggggatcccacggaggtcctcctccccacgctttaagtattcgatcgctgtccagcttaaatacgcagaattgacgtcaatatgaaaaataatatgccgcatcgtcattcccgcctttcctctttgctactttctatggtaacagcaaaagacgcgggattccagtgaaatcctgcgtcttgggtcatcttttttattgtgcgtattatcctttcattccgctgatggtgattccctcttcaaacttggattggagaatcagatagaagagaaacggtggaaggaaggtcacggccgctcctgccatgacaagtcctacatcggtgtcataggctgtccgcatcgtgctgatggcaaggggcagagtacgcatcgcatcctccgtcgtcgcaatcaaaggccagaggaaattgttccatgcccctacaaaggtaaagatcgcaagggtcatcattgccgactttacaagaggcagaatcaccttccacaaaatcttcatatctcccgcaccgtcaatcttggcggactcaatcagctcttttggcaccccgatgatcgcctgccgcatgataaacaccccaaaggcagtcggaagcggcagaatcagcgccttgaatgtattgatccagtcaaatcccctgacgatgaggtaaagtggtacgatgatgacttcagatggtaccaccatcgtcatcatcaggaagaaaaagatcttgtcattcccccggaatttgagctttgcaaaagaatatcccgcaaggcagctaaccagaaggctcagccccactcctccaaacgcgacaatcatactgttcagcagataccgaaagaaatgattcttcgtaaagattttaacgtactgctccagcgtaatctccgacaggctgatgctgaaatcgtaggcattcaccgtacttttcagcgacatcaacaacatatagataaacgggagtacgcaaaacaccgcagtaatcaaaagaatgatatcaccgagaatccccggcagctttttctttattttcatggcctgtcctccctttttctatatttcagaagcttctctcttcataaagcccttttgcagcaccagaaccgccagaacaatgaggaacaaaatattggataccgccattgcgtacccggcttttcccgtcttaaacgtcagattgtatgcgtaaagtaccatggtcgtagtcgagtttgccggacctccgcctgtcatcgtgtagatcagttcaaagctctgcaaagaactgacaacgcttaaaaagatatccataataatagccggcttcatcaacggcagtgtgatgtagcgaaagcgctgtaaacgcccgccaccatccacttttgccgcctcatagtaactgtccggaatcgacatcaaagtagacagattcaagaccatatagtatccgaaccctttccacaccataatcatagctaccgtcacgatcgctgtcgtactgcttccaagaagcatcgccgtatccacgccaaaaagggcaaagaagtccgacagtaccggcgttctgccgtttaagatcgtcttccataccgttcctacgactgcattcgaggaaatgacaggaataaaaatcgctgccttggcaaacttgccgatcagagaatgttttctggatgccaccaaaatggcaaacagcacagacaatactacctggagcggtactacaagtaccatcactttcaacgtatttatcacggcaagatgcagcttcggatccgtcagcatctttttgtaattgtcaaactggataaactccgggtccagaagcaggttgtactttgtaaaactgaacaccagcgaaatcaccactgatccgaccacgaatgtcagaaggatcagactgatcggcatcacatacccgtaaggcgcgatggaggataaaaattttctcccttttttcatctttactcctttttcaatccggaaagaaaactactctttgtctgcccagtattcatccagcgcctgatctccataggctgccgcgtcatccagtgcttccttcggagttttgttcccttccatcatgccctgaagctcggaagccagattctgaaggatatcacttccgcaaggtcctacctgaagtggacgatatttgtctctgtcctcagttacgatgcgttccatcttcgcgtctccttgatatggttcgctctttgtaagaggagctccggacgcgatcttgtgatactctgtcataaattcagatcctgtgatgtacttgataagcttcatgcaaagcttaggattcttggcctgggaagataaagtcagacagtctgttgcgccgaatgtaccgtaatctttgttctttaaggatgtcacataattccagttcagattcggataagattccttaaagagtgtctcctgaatcgcagaagaacgtgtcacgccaaatgcagctttaccctgaccgaaaatcgtggagaaagcatcttctgctgccagtgacatcatattctccggcatataatccttcaggctcaggaaaaactctgccgcctcctggcctgcttcattattgaatttcaccgtcttataatcatcattgtagatatccgtaccggactgccataagaggctgtagaagtacgcattcagaagatacagcatgttcatgcttccgttattaaagccaaccgcatatccgtactgatccactttgccgtcgccatctgtatccttcgtcgctttttcacagatgcgcttgaagtcatcccatgtctgcggcggctgttctcccagctcgtttaaaatatcttcattatagtaaagaacaaacgggacgcctgttacaatcgggaatccatactgtccgtccatcatatatccgtgatccaggtagaggtactcctctttatcctcgtccgtaatatattcggtcatatccgcaaccgctccggaatcaatgtaagtcgggaacatctccgcatacatatatccaatatccggaagttcccctgaagccgccccggagctccatttctcctcatagttctcccacggctgaacctgaatatcaatctcacagttgttttcctctttgaagtcttccagaagcggctcccagttttccaacagattgtcgtccaacggtgggcaccacattgtgattgtttctttttctccgtcaccgctcttcttgtcatcgtccccggactttccgcatcctgccagaagtcctgtcaccatagcagcacagagcagcacacttaccagtttcttcttcatgttctctcctccaaacatcctttgaaataaattgatagcatatctattatagctgtgtcagtccgcctcaacaaatcattaatttctatacctctatagacattctctatagtcctgccattgtccgcacttcatccatccagatatccagttttttaaaatccgtattgtacggaacatcacacccactcgcactgatataaccctttgggcttccctttgcaaggtctgtttccctgcggatttcctcccgcagagtctcctcgcttccctccagcagacactccaccggaggaagattgcccacgatcgtcatccggtctccaagcgcttcttttgcctccccaagatccatgatattgtcaaggctgatagcccggatcggcatttcccggaaatactcccacacttttttggtattcccgcagatgtgaagagacggtcgtttcccggttttttcctcggcatacttcataatctctacaagatacgggtacaccagctcccggaaataccgtggggaaatgagcgccggggaagcaaccggatctgccaagcgaatcccgtccgcaaaaggggcgaccatatctacacagtttttcatcgtatccgtcacgagacgcagcagtctttgcacctgctccggctccttcctcagatcccgtagaaactgctccacgccccggagattggcggcaatggtaaaaggccctccgatacttggagccacgtccacaatgccgtccgccgcctctttcatgcgctccattgcttcccggaaaaacaaaaggcgttctgcgtttgcggcacttgccggctccatctcatctaacatccggtaatctttaagatacgcaccattaaagtacggcatcccctcctccgggtagacaaccgtaccgccaagggactccagaatgccgcaggtgttcggtccaagacttagctcatcgtgtcccagcctggtaaatgccgccagttctgcctccaccatctttgcggcgtcatgccaatactcccggctggagattcccacaagccgtcccgatatctctccaataaacggaatgaccgaaatccgatccgtctcctctccccgctccatagcaatcctgcgctcatggggcgtcatgcggtcccgtctgtttgcttctgctctcatctttcactgcctccctttttccccggaaagatcatgctctccgtaaagatccgctcataattctccgtttccgccagctccatatattcgatatctgacgccagcgcttccatctttgctttcatcttttcggacatgagggtcatgtacgccccggtcttggaggaattccccacatacaccaggcggttctccacctcttctggcaggatgcccaccccggtcaggaattctgccggtaggtgtgctccgaactgacccgcaatgagtaccttgtccagatcctccatcccgatgcctgctttctttaacagtgccgtaaatccggacagaatcgctcctttggcaagctgcacctggcggacgtctccctgggtgataaacagatcccgcttctcgtcgagcacaaactcccgctttgtaccattgagccggatcagatgctgccggtaatcttcctcacccaacgcttctttcttcacaaaaacacctgttttctttacgatacctgtgcgaagcagttctttgaccgccgccagaatcccgctcccacagacacccttcggaggcatgtctccgatggacgtaagaagaacacctttctcggtgatttgcacgtcctccaccgcaccgtcctccgcccgcatcccacaactgatgttcattccttccagagccggtcctgccgcgcaggaacagctcagaatccgtccgttacttgccagaacaatctcgccgttggttccgatgtcgataaacagtacccggcccggttcctcttgcagaccacacacacagactcctgccacaatatccgccccgatataagaggaaaccgacggcagacagtaaaggatcgtctcctcccctgccatcagcccgatctccctggcatgcatgattttcgctcctgtaaaggcaggctgatacggcgcccttccgatggaccgtgcgtccacgccaatcagcatatgcatcatcgtacaattcgctgccacatcgatttcccggatctcctcccgggaaatccgcacctcttcacaaagcttttccagttccatatttaacgaatccacgatcgctttccgcagctcttctgctccggtctccggatgatcatactcgtaagtgattctggtaagtacatcttgcccgaacctcttctgagcattgagcatggaaccttgagagagcaccttcccgtctgagagacgcaccagatccatcgccaccgtggtagtaccaatatccactgccaccccatagccctcccggaattccttttcaaattccggcataaaacctgttgtcagcacgtttccttctttctcttctcccagaagctctacctccagatcttctgtcacctctaccagacaggaaagttgaacctccgccttgtccccggacagaatgtgaaccttgcactttccacaggtgccgtttccattgcacggattatccacaaaaaagccctcctttaagagggtttttaatagattggctccggtctcacaaagaatgatttttttgcttccctttacgcgaatctcaggcatgggtttcctcctttctgaccgccgctaaaattgcccggatattagcaagcggagaacgcatccccagaccgcatgccggtgcgatgatgtcggaaccatttttcacacagttttcggtcagagtttctaccttgtccggctccccgaattccagggtgtaggtgctcacatttcccatgagcgtccggtctttgagctcacttctcgcttctttcatcggcacgaccgaatcaaaactcagtgcgtcgctgtgaatctcattcacctctttgtacaccggattcatatgaccgcagatatgcacgatcgtctgtgctcccgcttccttcatggcatccacaatctgattgacataacgaacggtaaactcttcgaaaaatttcggtcccaggatttccccggtggcactcggatcggaaagagcgatcacgtccgctcctgcctcaatctgcgcctttccaaaacggataagctgatcggtcacgaactgcatgtacccatgggcgtcctcattctttttacggagctctttataaaagatgaccggctccatcaccgaactggctgtacttaccggtccggttaaatttccaacaatcgggacgtcatttccctccgctttcagaatccggatggcatccagcacgacacgtgcccgcccatgctccggatcaaccgacggcagcttcttccagtcgctcactgtctccataacgtactccgtcacatgaggctcataggcactggagcctaaatccactttcgcccccatctcttctgcctcgatcgtcatgcaaaacggaaccccgtaattttcaaagcatccctgttcgtagactgcttttgcaagtcccgacatcatcgccgcatccgtgtgcgcctgcggcaggtaaatctgaacggtctgcatcagttcttctgttatcatattcatcatgccgccaggacagatacatggcgtccgatccgcctttttcccggaaagcacggtctgtaatcgttcttttggtgtaaacatttctttctcctcttctttttgcttccccattcgtttcctatgcgatctgaagcagatttttcgcaagccgcaccgcctccaccgcattctgggagtagccgtccgccccgatcttgtccgcaaagtttctggataccgggccgccgcctaccatgactttgacatccttccggattcccgcttcctccaggagatcaatgaccgttttcatgccacccatcgttgtggtcatcaatgtagacaggcaaaccagatccgcatgggtctcttttgccgtatctacaaatttctgaagcggaacatctctgcccaaatcgatcatctcaaatccggctgtctccatcataattttaacgaggttctttccgatatcgtgggtgtctccttccacaacgccgatgactgctttctttttactctccgggtcctcttccgggagatacggctttaagacactcagccccgcatacatggcatccgaacagagcagcacgtcagtgacgaaatactcttcttcttcaaacaggacgctggtacggttcatcccatcgatgagcccttccataatcccctccagcgccggatacccggcgtcgataaactcctgggcagcctcagccacatcgtcttcttccatatcgacaacaccgtcggacattctctttaataattcttctttcaaactcattgttttcctcctttgtctgctttccggcagatctgaaatctgttttctgtctgccaacacaggctctctttttctatttctttcttatgcgtggctttctttaatctctatcgtcatcagctttccatttgtaatctttgtcccgctccggttgatgcacatctgggatggaaactgcgctttcccaatcgcacagacacaggcttcctggtacgtcatctctcccggaagtggacattcgcctcgctttccaaggtctgtcccgatcagggcaaacactgtcttcggacagagaatcatcgccatatcatctcccagaatgtcagcggcctttttcagaaacggggcagtaaacgttcttgtcatccattccatggatttcggccccagaatccgcacactcccggcggaatccgcatagcttacaagccgtactcccgcctttttgacttccacaagcaggcggagcatctccgtctctatcatcccgaaaatctcctccatctgatccggagttttccggattcctttgagaatgtgcttcacatcaatcaatgtattccagatcgtcaaaggaccggacatctgaaacagcacttcctccccctgctttcgcagttcccggcagacatcgagggtttctttcatcctcccgctgtcaaaatccattcccgaaatcgcttttaactcctcaagactctgacaaataggcttctctgctctcggccctgccgtctcatttccataacgcacgttcccgcccatcgccccggcttccagtgtatgatcaaacggaatcgtacaaaacggtttcctgttctgttctttttccagctttgcaaaccgcaggatctcttccatctttacataaatctccggcaccggaagctggtatgtccggatcacttctaacatcccgtgatcgctgtcttccggtctgcactcataatcctgaatcatagagtttccacctcgtttctgtctcattcccttctctgtctgttagtactattatacatgagaatggggaaaaaacaatttgcaatattagaaaaggaggaacattccatttgtcagaatgttcctcctgtccatataactctcggtttttgctatcatttcttccgggactctctttttctattcccggtactccatcggcactttcccgcctgtggacgcggtcaggtctccgtctttttcatcgatgatgatcgtatctccggaccccacattgcctgccagaatcagttttgccgccagtgtttccacatatttttgcagataccgcttcaatggccttgcgccgtacatcggatcgtatccgccgtccacaatgtgctgctttgccgctctcgtcaactcgatatgcagatcccgatccgcaagccgtctgttgacgtctttcacgagcagatctacgatgcctgtaatgttctctcttgtcagcggtctgaacatgataatctcatccagacgatttagaaattccggacggaaatgggctttcagctcattcatcacaagctcctcattttcaggacggatatttccgttgtcgtcgattccctccagcaaataagaggaaccgatattggatgtcataatgagaatcgtattcttaaagtctaccgttcttccctgggaatccgtgatccgtccgtcatccagaacctgtaacaggacgttaaacacatccggatgtgctttctccacctcgtcaaagaggacaacggagtatggttttctccggactgcctcagtaagctgtccaccctcgtcgtatccgacatatcccggaggcgctccgatcagacgggacacggaatatttctccatatactcgctcatatcgatacggaccatatttttctcatcgtcaaacaagctttccgcaagtgctttcgcaagctccgtctttccgactccggtcggtccaaggaagaggaaggatccgatcggcttggtcgggtctttgatccctgccttggaacggatgatcgcctctgtcacttttgtgacgccttcatcctgtccaatcacacgtttgtggagttcctggtcaagatgaagtgtcttgctccgctcgctctcgttgagctttgcaaccggaattcctgtccaccgggaaacgatccgtgcaatctcatcttccgtaacactctcgtgtaccagagacatctcctcgtctttgaccttggcttcctcttcttccaactgctttttcaactgtggcaggcgaccatactgaagttccgctgccttttccaagtcatagctgctctgcgctttttgaatctcctggttaacgctttcgatctcctcacgaagacgatgtacccgctccagagaggatttctcattgtcccactgtgccttttgacgggcaaattcttcccggttctccgccagttcttcctgcaatttcaccagacgctcctgacttaatcggtcatcttcctttttcagtgctgcctcttcaatctctaactgcatggttctgcggcgaagctcatccagctccgtcggcatggagtcaagctccgttttgatgagagcacacgcctcatccaccaggtcaatcgccttatccggcaaaaaccggtcagaaatataacggtttgacaaggttgccgccgccacaagcgcgctgtctgtaatcttgacaccgtggaagacctcataccgctctttgagcccacgcaggatggagatggcgtcctccaccgtcggctcatctaccataaccggctggaatcttcgttccagtgccgcgtctttttcaatatattcccggtattcatccagggtcgtggccccaatacaatgaagctctcctcgtgccagcattggtttgagcatatttcccgcatccatcgagccctccgtttttccggcacccacgatggtatgcagctcatcgatgaaaaggatcatctctccatcactgtttttcacttcttccagaacggctttcagacgctcctcaaactcgccccggtacttcgccccggcaacgagcgctcccatgtccagagcgaacagtcttttattctttagtccctccggcacgtcgccccgcacaatccgctgtgccagcccctcgacaaccgccgtctttccaacacccggctctccgatcagaaccggattatttttcgtctttcttgaaaggatccgcacaacattccgaatctccgcatcccgtccgataaccggatcaagcttctgctctctcgcccgctccaccaggtcgtaaccgtacttattgagtgtatcgtaggtcgcctccggattgtcgcttgtcactctctgattccctctgacttcggagaggacccggagaaaattctcccggttgatactgaattctttgaaaatatcctttacttcacggttcgcatatttcaaaagcgccaggaaaatgtgctccacagagacgtattcgtctcccatctgcttcgcctcatcctccgcatgaatcagcactttattcagattctgtccaataaagagctgaccgccctgcactttcggacgtttcctaagcgcctgttccacacgctcaatcaaaagtgtcttctcaatccccagcttttccatcagctttaagatcaaactctcatcctgagtaagcaaagaatagaggagatgctcctgttcgatctcctgattcccgtattcgtccgcgactttctcgcacccctgaaccgcaagcatagaattctgtgtgaatttgttaatattcatacgcttcttcctccttacgaatgtataactctatctcgtctcattgttcgtctgttctattgacaatataacaataacatttgttgttagcagtgtcaagaggtgagtgctaaaattttttgaatttgttccaaaacccaaatctatattctgaacaggagcccttatcatcattataccaaaagacccattccctggcatctcgacataccatatactcttcactgtcaaaatatacgtttcatttcattttactggtcttctttcattgtattatatgtcagattctctgcagcagccaacccattttctggcacatgatactgatgaatcttagaagatttgacaggtgcacaatctaatatggatatatctgaatgttcctcaaagttttcaacctgctccatgaccttactaaatacttccggactgtactgtgggggatatccatttttaaccagacatattttgatatcaagtttcaactggttgcgaatattcttgttgttcagccaatccgcaaacgaagactttgtatcgatgatttcttttacctttttcgccagtgccctgcacttctcattgatcgtaacaccatcgatttccctgtcggtgccgtattcaaaatgatattgatttcgtaaggcaatcaatatatcgtagaacgctttttcttcaaaagttagcccaatcttacgaaaactttccctgtcctcgtccatctgccggaggatagtcagagctttctccgttgcaatcctgatgatgtcctcacaagcttgttcctgtgtctctccggcttcctccgcggtaagatgcttacgcctttcgtgatattcctcgattgtcttttccagcatttcctggaacgtctttgcggctaatcggttgacttttccgtattcctgaatctgtctgcgaagcatttttacaagaagttccagtttcgttgccggcatttttacatccgacagtttttcaaagtattcaggagagaaaaggtcctcttcctccccgctttccagaacgctttccacccgattgtactttaatgctgcctcaaccattttcgcgactgtacgattcatggtatctgtgtccactccacttgttccactcatttttcgcacaaatcctgctatagccataaaacactgtgcaagtgctgtttcctcctcgctaagctcaccggaaggctgacaaatgtcatatgccgctctcattctcttaacagtttttaaatagtatgttttgaatgaaactttctgaatccctctatttccttctgttttcaattcctgtgtcgacacaaatacatattcagcagccattgcaagcagccggtaacgctctatcggattgcaatttggatttaagaaagggctcaaatcataatcttgaaacaagacttttaagatttccagttcttccctgaatgttgttgcagcctgttcgacatcatcagatgtgggcgcgacggacgtattgccgccatacatcttcatagcttcacgcatattgtcgcgaatcccgatataatctataatcatgccaaactctttcccaggatatcttctgtttacacggctgatcgtctggatcagtaaatgttttttgagcggcttgtcgttatatagatatgtaagagatggaacatcaaagcccgtaatccacatatctacaacaatggcaatatggaaatttgacttttcctgcttaaaagccgcatccatctcttccgagcgcttgtcattgcgaacgccgccgagataactgtacatctctttctcatcgttcttcccaacacttgcaatcatggcaataaaaggcatcggttttaattctttttgttcttctgctgtgacaaaaatatcgtcaggcgctttcttttcctcaaaccattctgggtattgatccttaaatttctgtaataaagcataggcaatcttacgattggaacagacaatcattgctttttgtattctgtccgggtctcctgaacaggaagaaacataatgatcgtggatatcaatagcaaggcgttctaaccgtgacggctcaccaagaatcacttccatggagctcattgctttcttacttgcctcaatatcttcataggtcgctccgtcatcggcacatttcctgtagtaatcttcgatttctttcgctttctgtttatcaagcaggacttttgcgatgcgcggatgatatttgatcgataccgtcaagccatccgcaaccgcctgatccatggtatatcgatcgatttcgtcaccaaaagtctggtaggtttccgcaatcggagtgcctgtaaatcccacaaaaattgcctgtggaaatgcctctttcaaaactttggcatatggttttgaaaccattgctttcatattttcgtcagcgtctttgctgaacctgatttttttggcatgttctaactgggttctgtgtgcctcgtcagaaaagcaaataatattctgtcggtcattgatcagaccgattttatcctctttacggtcgcaaaacttctggatcgtacagatataaaacccaccactttgccgtgctccaagttccgcccttaactgcactctgtctttcacaacagacacttcgccaagattcagaaattctgtactctttgtaaaaagcttggcaccctgcttttgcagttcatcccggtcaacaatcaagatgattgtcggcgatccgatttggggagtttctgtacagcgaagtgcaagctggcgggcaagaaatgccatggtataggttttcccacatcccgtcgctccaaaatatgtgcctccttttctgctcttttgcataactgattttacaatgctctgcttcaataatcttgtagcaaaaaactgaggataacggcatacgatttctctctcttcgctgtcataaatactgtcctgaaaataaatataatctctgaatatctccagaaaacgctccggcgcatacactccttgaatcatggtctgggtttccgcaaaaggaagcgtagatatcgcgtcgccgtcatggactcttctccatgcatagaaatgctcatacggtgtacgagcggtcccaagtcttgtttttaccccatccgaaatgcacgctaacgggcaatagtgtaaaagatgcggaatatctctccagtaacgaatattgatctgttcccatgcgtcataaatagtagcattggcgtcagcaggatttttcagctctatgatacatactggtattccattcacaaataaaagaatatccggtctgcgtgtttctttctgtccattgtcggtatactctaccgtaaactggttaacaacacgaaagatattatgttctgtgttttcaaaatcaatcaatgatatcatgcgtgcctgtccattctgaggagtaaactgaatcccgtttaccatccatccataaaccttatgtaaagtagcaaaatcgctttcactaccaacaagacgcacagtatcatagatccgtgtcacttcctcatctgtcaaatccggatttgtgtcggcgataaattgtttgaaatcatcagcaatcaatacattccttttcgtgatacgtgcaatttgattacctgaagcatatttccatccttccgcttccagaaagctgataaaagcatcttcgtactccgattcacagtaccgaccgttatattcttttaatttcgccatccattacacctccttcgtatttctcgcttcctcgatagaaccttttatcaaaatcggacagatgtttttgatttgtgttttcagtttttcgtttattcgggttctcgttatgagaactttgtgcaactcagaaacaatttgctgctctctctcatttgcctctggaattgtcagatctaaaaattcctcccatgataaactccctcttgcacttgtatcacaggagaaccatccacgccgttcaaattctgaacggttcacattggccataaaataatctgaattgatattctctgttttaaatgtgtaatacgcaggggatattaaataattttcttcagaatcatttctcgcgatagttaatctgccatctcttcctactttcattaaaactccaccgtattcaccaggtgctacaattttgtaatttgaaaaattcaatccatttgcatccgctatcgagtttataaaataattatccatactaagtcctttaaatgaataaggttccccagatgtatttctattatcaatttgacgtacataatttctgataggcactctacgttttgagtgctttaatctgtcaatatacgcgtcacaaacaagtttcaaatcttccaatcctcgttcatagctttgccgattggtaagcatagcgttgtaaacatctacatattttcgctgaattgaaagtggcggtaattcgatagttatatcacacatatcctcccaactaaatgtctcccttgcagacccccaagaatgaaaccgcgaataacgatcaaattcagggcgatgaaagtacataaaaagataatctgaaagtagtaaatccttctcctttacgcagaatacaatataagaagaagaaacaatatatgtatgatcgcttgtattatgtgccagggtgattttctccccatttctagatgttacagtaacataggcaaaatcatccggttgaactaagtaatagggttttagagatacaccagacatatcggcttttgtctctataaaaatctttttaattgaaattccttttacatcatctattccgaaccgcaaatcatcgtttttctcatcacatatctgtattaaattacccagcttatacttagtcaatcccatatccaatccccctaaacgcatcttccaacatctgacgggattgcttttcctgacgcatgatttctttcatttcctcctgaatacgagtcatttccttttcatagtcaatctctaaatcatggtcaacaaattcaatatatttgcttggagtaagcgtccagcctttgttttcaatttcagcaattccaacacttcggtaaagctctggcatctgataattgtctccatctgtactttcactttgccatatatgataaatctttgctgctctttctatctgctctgttacgaaacaaactttctttttattttcccctttcaccggatttcctctccattgccgtaaatccatgaaaaggatctcatgctcacggttacgaaggatttttccatgataatcaccgccttttttgttctgatttaaaatccaaagtgtcacactgatatcggtagtgataaataaatctcttggaagaacaataatcgcctccactttatccttttgaatcagcctcttccgaatttccattgtgtcactatcgtttaacgcaccatttgcaagcaggaatcctgcaacaccatctgatggtttcaaatgtgacaatatatgtaaaatccaagcataattagcattgcttgccggtggtgtcgtataatccgaccacctggcatcattctttagattatcgttataccaacctttcagattaaacggaggattagccataatatagttaaaatacaggcccttatgcagatcgtgggtaaaggaggagtcatttgtttcaccaaggtgatggctgagacctctcagggcaagattcatttttgcaagacgataggtcgccgcgtccttttcctgtccataaatattaattcgattgatatcaccctgttttgattttacaagttccgcgctctgaataaacatcccaccagagccgcagcaaggatcatataaagtaccgtcataaggctctatcattgtcgcgatcagttgtacgacatcatgtggagtatagaattccccttcctctttggttgcattaacggcaaattccttgagaaagtattcataaacacggccaatcagatctttttcctctccaaatgctttatgactgattttatttacttcgtccacaagcttcttaatatcattcggagcaaggttacgtgtagtaaaggttccttcgataaagcaacctttcagatcttttgagcttgtcgcaatactatgaagcgcagcatcgagagcgacattcaaaccaggtgcaggtgtattgatgatagttgaccaacgtgcttcaacaggcagattatatgtcccgtctgtaaaggtggcatcatcaaaaaaagcggctctgatattctcattgtccgggtcaagtccctgttccactaaaatctgacggagcttttccactccatcctcatatttctcgccgataaagcgtaagaatacaagcgtaagcatcatatctcttttttcaaaaaatgaacccgaattacgtgccgcccgcaaaatatctctacagttaaataaaatatgatctatatttaatgctttttcagcagttttctttttagccatattgtttttgtcctttcgaatttcaagcatttttattatataattgcttttgtttataacacagcattattatatcaatatttttaaatatttccagtaaataaagaataacacaacaaatatcatatcttcgtttcccctgccttcattatactgtatccgctctaaaaaatacagctatcttatccatcctcttcttttcattccttccctaatagcaacattttgttgctttatttcattaagatccattccgttgcactgtctgaattttttatccagaaactgatatactgttgaaaaatggaggtatgttatggcaaatgtgcagcttgcaaaaaatttaaagatacttcgtaaaaaacacaactatacacagcaagacttgagtgatattttaaatattaccagacaagcatactcccactatgaacaggctcttcgagaaccggatctcaatactctggtccatctctcccatctttataaagtctctttggatgaactcattgcaggcaatattcatcccgacgaggtccgggaatccatgcccgtctacaaatatcgccttggtgagacgtctgaccataaatggtctatttgtctgactgaacaagatctaaatttgcttgaaaagttccgtaatgcgagcgaaaatactcagcaggtaatactagaatttctcgacaaaagctgaaacttcctagaatatcattgtacgactctacctatcgaaaaactgccgacagcacagctatcggcagttttctatttctctgtcttattaatcattcagtccgaatccgtcatggatggcgatcatcgctttttccgtatctttctcatcaatcagaaccgtgatccggatttctgatgtagagatcatgctgatattgatattggagttaaacagagattcaaacatctttgcggcaacgcccggattgctgagcattccggctcctacgatagaaacttttgctacatcagtgctgtatgtaatctccttgatcgtaagaacgtcctttttctcctccagaatctgcagtgcttcctgcagatcatcctctgacacggtaaaggaaatatcttttgttccgtttcttccaacagactgtaggatgatatctacattaatattatttctggcaagtgtattgaacagtttaaacgcaataccaggctcgtctttcactccgatcgctgagattcttactgtatttctatcggccgccacaccggtgattaacattttttccatttttactacctccttgactacggttccttcctctgatgtaagactggagcgcacaaccagctccacgccatatttctttgccatctcgacggaacgattgtggagcaccttggctccggacgttgctagttccaacatctcgtcataaataatctcatcgatttttctggcatttttaacaattctcggatccgctgtgtatacaccatccacatccgtatagatctcacacttgtcagcatgaagagccgctgccagtgccactgcggtcgtatcagaaccgcctcttcccagagtagaataatcatcgtacttgttaataccctggaatccggtcacaatcacaatctttctagcctccagctcatgctgaatccgctcggtatcaatccgtttaaatcttgcattcccgtatcttgccgtgcagtgcatccgcacctggaatgcgtttaaggaaatggccggaatatcataagaatgaaaggccattgccattagggcaaccgacacctgttctcccgtagtcagaagcatatccaattctcgttttggcgcattcggattgatgctctgcgccagttccaaaagctcgtctgttgtatctcccatagctgaaagtactacaataatatcattcccttttttgtagtcctcgatgcagcgtctggctacattgaagattctttctctgttcgcgacagagcttcccccgaatttctttactatcagcataatttcctcctagtattcaaataagtgttctatcagatgatatccatccttcacccatcttcccgactccctggctgcccgctcacagtagcttcccccgcagaaggaatgttttcggctgtcatagagaagataaggaaccggatctgctgtgtgcgtccgggccgaaaccggcgtcggatgatccggcagaatcagcatcctgtactgctcccctgaagcgtccatggcctcgcagacgatccgtatcagccgctggtccagatactcaatggcctgaatcttctgcttggcacttccctgatgtcccatctcatccggtgcttctacatggatataggcaaaatcatatccctcctttaaaagcgcatgaactgccgcctgtgctttaccctcgtaattggtatgaagacctccggtcgcgccttccacatggagattggtcatcccccctgcggccgcgatcccttttaagagatccacagctgaaatcatcacaccctttttcccagtcttttcataaaaatccggcagtttcggcctgctcccggctccccagaaccatgccgaatttgctggacgaagtccgcacttcttccgttcgatattcagcggatgcacctttaagagctcgtaactttgctccatcatagagcagagtaaagcatcctccggcagataagcgccgatctcctttgtcagaatgtcatggggtggcgtcagttcatagcgtttccccttttcccataaaaggaggtggcggtacgatgttcccgtataaagtgaaaatcccattctcaggatatgctccttcagatatgcaatcagaatcgcagcatcctcggtacagatctcatcggaactgtgatctaccatgtgctgcttttcataggagagtctctcatcctcagtcagagtgaccagattgcagcggaacgaaatatcgtcctctgccatattcacaccgatactgaaagcctcaagaggggaacgccctgtataatatttacggggatcatacccgagaaccgacaaattggcagtgtcgctccccggcgccatcccttccggcaccatggaggccagaccgatctcacctttcgccgcaagccgatccatttccggagtctttgcccactccagcgtcgtcttgtctccaagcctctctaatggttctcctgccataccgtccccaagaatgatcagatacttcatctactcccattcccttctgctttcaactatcctcttctatctatcttatgatgccacacggatcatgtgaatcagattgccaaattccgctgcagccgattcatattcgccttcttttatctctccggtaacaaatgcgaattccccttcacatccatccgccgtcagatactgaacctctccaaacgcctcccgaatccggtctgcatacgcttctttcctgccagccatgcggataaagaactttcgtttcacatccatacgactcttgagttccatcttattcccggaccagtattcacaaatcgtccgatcctgataccgtgcagcctccacaatatccgccgtcacagcgcttgccgtaggcatcttgcctgccccgctgccatagaacatggagtctcccagggcattaccccttacgaagatcgcattgaacacaccatggacgcttgcaagcggatgctctgagtgaagtaaaaacggagccacgatcgcaccgattgttccgtcttcctgcttcatcgtcgcaagcagcttaatgaccatattcatctctttggcatagcgcatatcctgagctgtaatctttgtgatgccttcggtatagatatcctcaaagtccacctgtcttccagatacaatggaagataaaatggcaatcttccggcaggcatccattccttccacgtccgcttccggattacgctctgcatatccgttcgcctgagcttctcttaacacttcatcgtaatcggctccctcataaaacatcttcgtcatcatatagtttgtcgttccattgaggatacctgtgatctcttcaatctcatccgctgtaagtgaggagactaaaggacggataatcggaattccgccgccaacgcttgcctcaaacaggtaattcacatgatgctccttcgctgtctgtaaaagctccgacccgtgtgccgccacaagagccttgttggacgtcactacgttttttcctgcctccaggcttcgttttacaaaggtataggccggatccagtcctcccatgacctccactacgatatcaatgcttacgtcattgataatctgttcaaaatcatgcacaatcagctcctgtgccggatcccccggaaaatccctgagatccagaatatatttgatccgcacctgatcccccgcacaccggtcgatcttctcctgattcattcggaagacttccaatacgccggaaccgactgttccatatccaagtaccgcaacatgtatcatttttattccctccctactattttcagataatgcactccttctttctcctcaatcttcgcgaccatttccgagagatttcccgtggtagagagcacctccacactcagagtcaatgtcgccacaccgttgagcgggatactctggtggatcgtcagaatatttgccttatactctgccacctcgcttaaaatctccgccagcagtcccggaatatcctccatctgcaggacgagggtgattgtctgccccttttcattttcatggaaagggaaaatgtcatctttatatttataaaaagaacttctgctgattccggcagcttccgcagcctcgcctatagtcattcccttacgggtggcaagcagatgcttgacctccacaactttcagaagcacttccggaactgcctttttgttcagaacatagtattttgtcttatccattggcactctcctgtttcaggtaagcgttgataaaacggtcgatctcgccatccatcaccgcacctacattgctggtttcctcatttgttctatgatccttcaccagactgtacgggtgcatgacataggaacgaatctggtttccaaagcctatatctttaacctcgcctcgaatacccgacatcttctccgcctgctcctgctccatcatcaaatacagctttgctttgagcatctgcattgccttatccttattgtggtgctgtgaacgctcattctgacactgcacaacgatcccggtcggaagatgtgtgatccgaaccgcggaagacgtcttgttgatgtgctggccgcctgccccactggaacggtaggtgtcaatcttcaactcatcctcattgatttcgatgtcaatatccttgtctatatccgggatgacatcacacgacgcaaaggacgtctggcgtttgcccgccgaattaaacggagagatccgcaccagtctgtgaatccctttttctgatttcagaaatccataggcattctctccgtgtacctcaaatgtcacgtttttgattcccgcaatatctccgtcaatataatccaggacctccatagagaaaccatgacgctccacgaaccgagagtacatccggtacagcatctgattccagtcacatgcctctgttcctccagctcctgcatgaagagtcacaatggcgtcgcagttgtcgtactctccccctaggagggtactaatccgcacctcctccaggtgctcgtcaagccgccggatcccctcccgaatctcccctgcaagacttgcgtcctcctcttcttccgccatctccagaagggtatctgtatcctcaaactgacgattcagctcctcggctgtctgaatcgtatcttttaacatcttaagctctttcatcactttctgggaaccttccgtatcttcccagaaatccggctcttccatctttcgttccagttcttctactcgtttctcttttcccggcaggtcaaagtgaatcccttacttcctgaagaggtccctcatatgcctgcaattccagtcttagctgctcaagctcgaccactattctcacctcttttatgatttctttttaccgcagcactgtttatatttcaggccgcttccacacggacacgggtcgttcgggtacacctttttctctgtacgaactttcggtgcatgaactgctgaattgtccttgtttgtccctgtcacttttactacctgttctctttctactttctgttccatcttaatatggaagagaacacggatcgtatcggcttcaatggcctttgtcatctcaccgaacatatcatatccaagcatcttgtactctacaagcggatctttctgtccatatgcctgaagtccgattccctgacggagctgatccatatcatcgatatgatccatccacttgccatcgatcgctctaagcagtacgacacgctccacttctctgacatgctctgcatccggaaactcggcttctttggcctcgtatgctttcacagcacgctcttttaagaggtgcttaagctctttttgctcttttttgttgacgtcatccagtgtcaccgccggaatcatcgggatcgtctcatggagcaccacatccatgcctgcaatatcccactcctcgctggactgatctgccggagcgtatctgtccaccagatcttccacatactccgtaatcatatggtagatggaatcccgcatactctctccatccaatacccggcgtcgctcctcgtagatgatctctctttgctcgttcattacctggtcgtactccagaaggttcttccggattccgtagttgttgaactcgatcttcttctgcgccttttcgatggctccggaaagcatcttgtgctcaatctgctccccatccgcaacgcccagagcattgaagacggacatcagtttctcagatccgaacaggcgaagcagatcatcctccaaagacaggtaaaaacgggattctcccggatccccctgacgtccggaacgtccacggagctgattgtcgatccgcctggactcatgccgctcggtgccgatgatcttcaggcctccggcctccctcgctttatcgtccagcttaatatcggtaccacgtcccgccatgttggtagcgatcgtcaccgctccatgttgtccggcctcagaaacaatctgagcctccagctcatggaacttcgcgtttagtacattgtgcttgatgcctctctttctcagcatcttgctcaaaagctcactggtctcgatggtaatcgtaccgacaagaaccggctgtccctttgcgtgcgcctcctcgatggcgtcgcagaccgcaccaaatttctctttcttcgtcttatatacggcgtcgtccaaatccttccggatcaccggcatattcgttggaatctccacaacgtccattccgtaaatatcacggaattccttttcctctgtaagtgcggtaccagtcataccgcacttctttgcgtatttattaaagaagttctggaaggtgacagtagcaagtgtcttactctcccggttgaccttcacatgctcctttgcctcgatcgcctgatgcagaccgtcagaataacgtctacctggcatgatacgtccggtgaactcatcgacaataagaacctcgttatcctttaccacataatccttgtcacggaacatcagattgtgtgcccgcagagcaagaataatattgtgctgaatctccagattctccggatccgccaggttctcaatgtggaagaaattctccactttcttgactccgtcctctgtcaggttgatcgctttttccttctcattgacaatgaaatcgccggtctcttcgatttcctcacccagaatagcgttcatcttggaaaactcgccgcttgcctcgcctcgctccatctgtcttgccaaaatatcgcatgcttcatagagcttcgtggacttgctgctctgtccggaaataatcagcggagtcctcgcctcgtcaatcagaacggagtcgacctcatcgataatggcatatttgagccctctttgtacgagctgctctttatagatgaccatgttgtcccttaagtagtcaaatccgagttcattgttagtcacataggtaacatcgcaggcgtacgctgctcttctctggtcattgtccatgtcgttgagtacgactccgactttcaatcccaggaattcatgtactttccccatccactcagcgtcacgctttgccaggtaatcgttgactgtgacgatgtgtacaccttctcctgtgagggcgtttaagtatgccggcagcgtggacacgagggtcttaccttcaccggtcttcatctcggcaatacgcccctgatgaagtacgataccaccgatgagctgcacacggtagtgtttcatcccaatggaacgaacagccgcctctctcacggtcgcaaatgcctccggcaaaagatcatcaagcgtctctccctttgcgtatctttctttatattctcttgttttatctcttaactcttcgtcagaaagcttctgcatctcaggttccaaagcttcaatatgatctacgatcgggtagattctctttaactcatgctggctgtgtgtaccaaacactttctgtatcagtcccatgttttctgctccttatcgtttctaaaaaattaatccattcttcattttaacactatccacgggcttgttcaacctgtttctaaactgttcacaaactctttccatcgtgttcacaaaccacagcaccatatctctgacggagcacatcgtaaccgagcgtcccgccaaaaagatccagcgcgctcccaacggtaaaatcaatccgtcctccggaagcttctcccaaaatccggatgtctttttccgaagaaattccacccgcatacgtcaccggatgcgtcactcccttcttccatgaagcaaggagcttcacaagctccctgtcaatcccacggcagctcccctccacatccacaccgtggacaagaaattccgcacagtactcagcaagaagatccaaaagctcatgtgttacctccgcatctgtaaacgtctgccatcggtccgtcacaatcagatacctgccgtcccgttttctacagcttacatccaaaacgagcttttcccgtccgactgtttccttaagcctcgccagattctcccagcggatcgctccttccgcaaacacataggaggttacaatcacatggcttgctcctgctcttaaataatcttccgcgttctccggacggatcccgccaccaatctgcagacctcccggaaacgcggaaagcgcttccatggcctgatgccttgtcttttcaaagtaacgcgaggctggtggattcagtaaaatcacatgccctcctgtaagcccgtcctcccggtatctggaagcaaaccactgtgccggacgttccgccacaaaattcgtctgagcccagtcccctgtatctgtcaggcttccccctacaatctgctttacttttccattatgaatgtcgatacaaggccggaatttcatcactttgccctccttgcttttttacgttactacgtcaatttatttttttaccttaccacaagaatccctccgccgtcaagcaaaaacaccctgtagaacattacaataaataagagagcccgaaggctctcctatcttcccatatctgttctgccgtccccgtccagtgcattttctacgtcatctttgatatcccttgcaccgtcttcgacatcatcttttaagtctcttgcaccgtctttcatgtcttcgcccagatcgtcggcaccgtcttccaaggtgtcttttccgttcttgcggtcatcatccgttgtatccttggtgtcgctaccgtttgtcgcgtcattgacacggttttcacccgcacatgcggtcatacttccaagcatgaatacactcagcagaaccagagcggctcgtttccaagatttcatgtttcttccctcctgcaaaatagaatttgcactacttactatccgcagaaaatgaatttttatacttttttctgtttttttctttaaaatgaaatcacatcgctcatatcatattttcccgccggtttcccagccaaaaatttcgctgcttccaacgcccctttcgcaaagactgccttggaataagctgtatgcttaaactcaatcacttcgtcctcgccggcaaacagtacttcgtgctctcctacaatcgttccgccccttaccgcggaaattccgatctcctgtttctctcttggctttctttcctgacttctgtcatagcagtatgcatatttcatatcctgtgtctcattgatcgcgtctgccagagcaagagccgtcccgctcggagcgtctactttcttattatgatgcttttccacaatttcaatatcgtatcctgccggtgacagcacctttgccgcatcctgcagcagccgcatcagcagattgattccaagagacatgttcgcagatttgagcactgccgtctcttttgctgtatcctccaccttctgaatctgctccttagaaagtccggttgtgcaaaggacgaccggaagccgtctctttttacagttctcaagcagaccgtccaccgccttcgcgttagaaaaatcgatcactacatccgcctctacatcacagtcttgcagactgtcaaaaaccggatagccgtttaaacgcccttcacaggtatcgattcccgctacgatctcacactctttgtcttctgctgccatccttgtaatcacctgtcccatttttccattgcacccatgcatgataattcttaccatattacttttctccttttcgtaaagtcttcccaccttttagggaagtgtatccatatccaaagagggcgccttacggctccctcttctttctgatttccttatgcaagtttcagtccaaatttttccatctctttggcaagtgccatcttgtggtcctcctccatggaggaaagcggcatctttaattctccaacttcttttccaagcagattcatagcagttttgaccggtatcggattaacctcgcagaagagcttgtcgatcagcggcagtgcatctagctgcatcttaagacttcctttcagatcgccgtcaaagaacttctggcagagatcatgggtatattccggtgcgatattcgcaagcacggagatcacaccctttcctccaagagaaagaagcggcacgatctgatcgtcgtttcctgaatagagatccagctttccgtctgtgagctgcataatcttcgcaatctgggatatattgccggaagcctccttgatggctactatattttccacctttgcaagctccgccgctgtctccggcgtaatattgagtcctgtcctgctcgccacactataaaggatgatcggagcctttgcctctgccgccactgccttatagtgagcaatcagccctttctgtgtcgccttattataataaggtgttacaagcagcagtccatccacgccgtaatctaccgcttcccttgacatctcaatcgtcgtaaacgttgcgttagaacctgttccggcaataacagggattcgcttctttgcctgttcaaccgtaaacttaatgcactgcatgtgctcttcttctgtcaatgtggatgactctccggtcgtaccacagataataatcgcatccgtcttatgggcaatgtgatactcaatcagctcatctagcttctcgtaattgacggaaccatccggcaaaaacggcgttacaatcgctactcctgatcctgtaaatatagacatatcattacctccaactcgtttctttccttttcacactttagaacattaaatcgttattactgcaagtgtatcactattcccgatatgtgtcaaacatcaattccacgagcatttacaggatttctttttattcttcctggcactccagtttgctcaccgacacttcataggctgttctcttttccgtctccgtgtctgataatttctttatatattcccggctctgtacccgtccgagaatatgtacatgcgcgccgacttcaaatgaagaggcaaatctcgcgtttcgtccccagcagatacatggaatgtaatccgacttcccgtacggccggtttacagccagcagaagatccgcgatctccctgccaagcggcgttttgcggtataccggtgatttgcagatatacccgtccagaaaaatactgtttgtcttgacgccatccatatcctcatcgctctccacaaaggacacttcccttgcgaaaactgacagcaccagcctgtttttctgttcttcatgccgattataggatctgaactgtccctggacaataatatattcgcccacataatcctgcgtcacatcaatcagacgctcggagatcatcaccggaatccggtcctcagaattgctcagtctcttcacaaggacttccatcgtgtaaaatccttctccgaatacttcgtggctgaattcaaatgtacttgccacctgtcccataatcgtaacctggttgttttcaataatcttatctgacatgaaatgtaattctcccttcctctgataggtattttttatctttaatactttatgcccctctttgaaaggatatgacctatgaggaaatttttccagaaaattcgatcgacatattccgataaatatggatagaaatgcttgtaaaatccaaaaaatatggtagactatataagttgctacattatataagtagaaagaaggatgtaacgatatgaaaataaaacgtgaagacattcgtaatattgcgattattgcccatgtagaccacggcaaaacgaccctggtcgacgaactgttaaagcaaagcggcgttttccgtgaaaaccaggaggtcgaggagcgtgtcatggactccaacgacatcgaacgggaacgtgggatcacgatcctttccaaaaatacggccgttcattacaaaaatacaaaaatcaatatcatcgacactccaggacatgctgacttcggcggagaggtggaacgtgtcctcaagatggtaaacggcgtagtcctcgtagtggacgcgtttgaaggtccgatgccgcagaccaagtttgtgttgaaaaaagcgctggaattaaagctccctgtcattgtctgtatcaacaaaattgaccgcccggaagcccgtccggacgctgtcatcgatgagacactggagcttttcatggatctggatgcagacgacagccagctcgactgcccgtttgtctacgcttctgccaaagccggatactccattctggaactcgatgacaagccggaaaatatgattccgctctttgagacgattctggaatacattcccgctccggaaggagacccggatgcctccacacaggtactgatcagtaccatcgattacaatgaatatgtgggcagaatcggcgtcggcaaagtggacaatggaacgatccgtgtaaaccaggacgtgatcgtagtaaaccatcacgaaccagacaaacagaaaaaggttaaaatcagtaaactctacgagtttgatgggctaaacaaggtagaggtgcgagaagccggcgtcggttctatcgttgccatctccggtattgcggatatctccattggagacacgatctgctctccggacgacccgaaaccgattccgttccagaagatttctgagcctacgatttccatgcagttcaaggtcaatgacagtccgtttgcgggacaggaaggaaagtttgtaacctcccgtcatcttcgcgaccgtcttttcctggaactgaataccgacgtcagcctccgtgtggaagatacggatgatatggacagtttcaaggtgtccggccgtggcgagcttcatctctccgtgctgatcgagaatatgcgccgggaaggctacgaatttgctgtcagcaaggcggaagtgctctataaagaagatgaaaacggaaaacttctcgaaccgatggagctggtctacatcgatgttccggatgaattcaccggaaccgtcatcgacaagttaagccaaaggaagggtgagctccgcaacatgggcatgtcaaacggcgcctacacaagacttgaattctccatcccgtcccgcgggctgatcggataccgaggtgatttcctgactgacacgaagggaaacggaattatgaataccgcctttgatggctatgccccatataaaggcgagatccagtaccggaaaaacggttctctcatctcctttgaaaccggagaagcattgacttacggtctgttcaatgcccaggagcgcggtacgctctttatcggaccgggtgaacgtgtctactccggcatggtagtcggccagaatgccaagaccgacgacattgagctgaacgtttgccgtgcgaagcatctgaccaatacccgcgcttccggctcagacgatgcattaaaattgtctcctccgcgtatcctgagtctggaggaagcgcttgacttcatcgatacggatgagcttctggaagtcactccaaagagtcttcggatccgcaaaaagattctggattccaggctccgcaagcgtgacaatctgaaaaataaatgatggggtgtgtctgacatgaatctgttatggtttctggaaggcatacggactcctgcaggtaacgatttttttcaattcgttacctgttttgggcaggagacctttttgctttccgtactttgctttttttattggtgctatgacaagaagtttgcccgccggatcggactgacgtatttttcttccggccttgtagtgcaaaacctgaaaattatcttccggatcccgcgtccctggattctggatcctgatttccatccggtacaaagcgctataccacacgcaaccggctactccttccccagcggtcacacccagggtgcgacaagcctctttgcttcactggcgcttgggtccaaacaacggagtacaaaatttctctttaccgcctcctttctgcttgtcggattttcccggatgtatcttggcgtccatactccaaaggatgtgctgacttcccttgtgatctcccttgggttctctgtggcgtactcccggtatgcagatattctgtttcggcagatccgtactttgtctgccgtactggcggggatttcctgtttcgtacttgcctcagcctttcttctagtgaaatatgacggtctgccgtccatgtacgccgccgacacgatcaaggcagcaggtgcaggactcggttttgctctgggactgtggctagaagagacgtatctgcatttttccaccgctacccggacccgaatggggcagcttttgaaactggcactgggactaggctccactctaacgtggaaactcttactctccggatggagcgctcttcttctatggaaagtgttcgagtatgcgttcctcgtcgtgtggatcctctttctttaccccgccctcttcacttcggtacagaaaaacatctgattttttcattctattacttttactttataaattttatcagtaaacttatttttgaatttctgattttttagttatttataattgcatgtctgaagtcttcgtagtataataaggacaagaattcaaatctcagatttgaacggatcttctgccttggctgccgaatccggcgcctatgcaggaaatacaggaaaaaggagttgggcttatgaaatttattatgagaggaaagaatatcgatgtgacgcctgccttaaaggaaacaatcgaacacaaactcggaaaactggaaagatattttactcctgatactgaaatacacgttacgctcagcgtagataaggaagagcagaaaattgaagttactatcccgctgaagggaaatattatccgttccgaacagtctagcaacgatatgtacgtttccattgacctggttgaggagatcatcgaacgtcagcttcgcaaatataagaataaactcgtggaaaagcatcaggctggtgtggatttcaacaaaactttcgtagatgaccacgatcacgacagtgttgaggacgattccatccagatcatccgtacaaaacgttttggcatcaaaccgatgttcccagaggatgcctgcattcagatggaacttctcggacataatttttatgtatttactaatgccgagacagacgaggtgaatgttgtatacaagagaaagaacaacacgtatggtctgattgagccggaattccagtaggagggaatataaaaagagatttcgcctaaagcgaaatctctttttctgtgtatgcgacgaaccaaatcccgaaccttcgtggaatcttggcgtctgcttacaatcccggaatatgtctttgccacttctggcgatgaatgacactctatttgttgaaaagaagtatcttaccctcgtgtacggcaaaataacacttctctttccacccaagtcctgcctgtccgttggtcccctcagttagctctttctcaatctttcccttctccacatccggaacaaggcacacgatgcggacctgatctgtatattgtatatccagaatatgaatcccctgctgtgcgagaatatactggatttttccaaatccggtatattccgtccggatttccagtttagacgcgtattttctggtaataatagtacttgcaagcactccttccttagccgccccggagtatgcccgtaccagccctcccgttccaagaagcgtcccgccaaaataccgggtcaccacgaccaccgtgtcatggattccctctccggtcagcacatcaagcatcggcttgcctgctgttccacccggttctccatcgtcgctgaaacgctgtaattcaaaacgctcgcccagcacataagcatagcaatgatgggtggcattataatgcttcttccgaattttctctataaactccagtgcctcttcttctgtatcgatatgagagacttcggccaggaaccgggatttcttctctacgatctcgctttccccatgccccagcactgtcctatattcttccaacatgttccttcctcctcgtctgttcattttaactataacaggattttcgactttttcaaaactttttcttaaatttttctcagcgaatacggaagattgcaattttttctttatttcaatattgaaatttggtataatggtttggtataaaaggaggcaaatgctcatgaactatggtagaaaaaaagctgctaagaaacgaagggacattacctcgaaatccaaaatgaaaaagaagcgtcttggcgtacggatctttaaaggagtgcttctcactcttttgcttttgatggtagccggatgcgtgggcggcgggatattcctcaagaaggtcatcgacagcgccccggatgttaccccggaagatgtaaagccgacgggttacacatccgttgtctatgcttcggacaataagactgagacccagcggctcacttccgccggttccaaccgtgtttataaaaccatcgatgagatcccgaaggatctgcagcacgcttttgttgccatcgaggacgagcgtttttatgagcataacggaatcgatccaaaaggtatcgtacgtgccggaatgatcggtcttactaccggagatttttctcagggtgcttccaccctgacacagcagctgatcaagaataatatttttgacttcatgtctgaagatacgttcttcgacagactagaacggaaaattcaggagcagtatctggcactgaagctggaaaagcagatgtcaaaaagcgaaatcatggaaaactacttaaataccatcaacctgggtcagaatacgctcggcgtacaggcagcatcccagaggtatttcaacaaggacgtttcccagttgactctgtctgaaagcgcagtcatcgcggccatcacccagagtccaagctactacaatccgatcactcacccggatcacaatgcggatcgccgcaagcaggttcttaaaaacatgctggagcagggatacatttcccaggaggcccatgacgaggcgttggccgatgatgtctatgcccgcatccagaatgtcaatacgaacatcacgcagaacacgactcctcagagctacttcgtagatgcactgacagagcagattctgacagacttggaggatccggacgtcggacttggctacagtgaaactcaggcatacaataccctttacaagggcggtttaagtatctattctacccaagatcttgagatccagggcatctgtgaccaggtactcaacgacgacagcaattatccttacaaagtccaatacggcctgtcttacgcactgactgtaacaagggctgacggaacacaggagaattacagttccggtcatatcaagcagttccggaatatgaaatatggtctgacctttgattctgaggagcaggcacatcaggtcattgaatcgtttaaagcatccatcgcaaaagagggagatacctatgacgaggtcatcaatctctctccccagcctcaggcttctgtcactgtcattgatcaggcgacaggacagattaaggcgatggtcggcggccgtggcacaaagtcatccagtatgagtctgaaccgtgcctacaccggatctacaagacagccgggatcctgtttcaagatcctgtccacttacgctcctgctcttgacagcgcaggagaaacgctggcaaccattatcaaggacgagccgtacgaatacgcggacggtactccggtttccaactggtggggcaattactaccgtggcaatatgacaatgcggaaagccatcgaacagtctgcgaatatctgtgcggtcaagacactgacggagattaccccgcagcttggttttacctactgccagaacttcggactaagcacactggtcgaaagccgtacgacagacgagggtaaagtctttacagacattcaacagccgcttgctttaggcggtgtcacggacggtgtttataattacgaaatgtgcgctgcgtatgcagcaatcgccaatggcggcgtttaccaggagccgatcatgtacacgaagattcttgaccatgacggcaatgtcctgcttgaccgcacacagactcaggagaagcatactgtattgaaagattccaccgcttttctgctcaccagcgcgatggaagatgtcatcaaaaagggaaccgggactcctgcccgtctttccaatatggatgcggcagcaaagaccggtacgacctctaacaacgtggatctctggattgcgggttacacaccgtattatacctgtaccatctggtccggatacgatgacaatactcctcttgcggatcgtgagtgggattaccacctgaagatgtggaaaaaaatcatggatcagatcaatacgaccaagggtctggcctacacacagtttgaagaaccggattcggttgtagaacgcaccgtctgcacaagtaccggaaaacttgcagtatccggatgtcctgctgtaacagaatactttgatagggatacggctccgactcagagttgttccggacaccgttcagcaaagaaaccatcatctgacagtaaaaaggatgatgaatcttctgacagttccgatcaatctgatagtgctgatcaatctgacagtcattccgatgggaactcttctggcagcgattccacggattcttccgaatccactgacacaagccaggacagcacgaccggagaagacacttccggtgaaagctcagacgccaatcagggagtcacccagtagaagtcagagatcactccagtaaggcagttatcgttttcataacaacagcataaaagggaggtcgcatcagattatgcgtatctccctttctttatattcgcaattttttactgtttctttccgtctgtcctccgtaaggtcagccacttagtctaataccatttttgccgctccgcagattccagcgtcgtttccaagctccgccagcgcgaatgtcacatcctgatttgcaaaaaacgcacgctctttgtaaggcgtctcgacatatgggatcaatacttttcctgctttcgatacaccgcctccgataacgatcacagatggatctattgcagccgccagattggcaagcgcatatcccagatagcgtccgaattctacagcaatctcgtcagcgagacgatctcctgcctttactgcgtcaaacaccgtcttggcatttaccggcccctttctcaaggtgctgtcctgctctgtggattccagcctcttctttgcaagacgggtaattcccgttgcggatgcatactgctcaagacatccgtaatttccacagccgcatttctctgtctccccgtaattcacacagaggtgtccgatctctcctcccgccccatgtgctcctgtcaggatccggcctccgataaggattccgcctcctacgcctgttccaagagtcaccataatcatattcttgcatccgcgtccgccgccgagccacatctctcccagggctgccacatttgcgtcatttcctgtcgccgtccgtataccggtcagctcttccatctctgctttgacatttttctcttcccatccgaggttggcggtagatttcacaaatccctcctccgtaatcggagccggaacgccgattccgatacctgtcacctcttccttggaaattccctctttttccagtctgttcataagagatttggcgatatccggaagaatgtttcgtcctttctcctcgatccgagtcttgatctcccacttatcccgtatctttccatcctcctgaaataatcccaacttgacagtcgtacctccaatatcaattccaaaacaatacttcatttttctctttccttcctcttattttgccagactttcctgtacccgtctgtataattcttccgccgcattataacccatctgtttctgtctgtggttgacagcggcagactctacaataatcgccagatttcgtcccggacggatcgggatcgaatggcacacaaccttatttcctaagaactctgtagattcttccttaagaccaaggcggtcgtactctcggttcttgtcccactcttccatattgattaccagatcgatcgtctgtgtctcacgcacgctctgtaccccgaaaagactcttcacatccactataccaataccgcgcagctcgatgaaatgtcgggtaatatccggagctttccctaccaaggtgtcatcgctcactttgcgtatctcgaccacatcgtctgtgacaagccggtggccccggttaatcagctccagagccgcctcactcttaccgataccgctctcacccataataagtacaccgacgccgtacacgtcaaccaaaacaccgtgaattgagatacacggcgccagttctacattgagccaccggatcacctccgccgtaaacgccgaagtctgcttgctggactggaagatcggcactttcatctcattggccatctgaaggaacgtctcatccggttccagatttcggcaatatacaatacacggaatcccataggagagaagctgtgtatacatctctttcttcttctcgtccgaaagagtttccagatatgtatactctacatatccgatgatctgaacacgatccgaatcaaagtggtcaaaataccccgtaagctgcaatgccggacgattgatatccggaacctgaatctctgactgtgtaagatcaagatccggcgtcagatttttcagactcatcttttcaattaacttttcaagcttcacacccatatttgttctccttatctgtctcatatgaaatcactttgtgaatagtatatcatatcaatggaaaaagttgtacacatcctgagcagatttttcattcattgtagggagttttttcagttcctcaacgtctgcctgacggatggcatccagactctggaagtgtttcattaaatcctttctgcgctttggacccactcctggaatctcatccagaatcgaatgaacctgcccctgcccccgaagttttcggtgaaactcgatggcaaaacggtgtgcctcatcctgtacacgggtaatgagcttaaatgcctcagaatccgtccggatcggaagctcctcgtcccgatagtaaagtcccctcgtacgatgccggtcatcctttaccattccacagactggaatctgaatatgcagcgcgtccaacacttcctccgcaatgtgaacctgtccctttccaccgtccattaggatgagatccgggaagacagtaaatccaccgaattccttgccctcttccttctctttcagaccatgctgaaaccgtctcgtaaggacttccctcatgcttgcgtaatcgtcagccccttccacacccttaatacgaaatttccggtaatcgctccgctttggctttccgtcctcgtagacaaccatggaacccaccgatgcgaacccattcgtattggaaatatcaaacgcctccatccggtgaataccggcgattccgatgatctgctccagttctcttacagcccccgttgttcttcctgcctcccggataagccgctccttgtcctttgcaagaaccatggccgcattcttctgtgcaagctcgcagagcttttctttttcaccctttttgggaactgtgaacgtcaccttatgacctctgcgcttcgtcatccactctgtcagaagatccgcctccgcaagctcataaggaagcagaagctcccgtgggatatacggcgtcccggcataaaactgcttaataaaacttgccagaatttccgcttttgtctcatccgggtcggtccgcagatagaagtgatcccggccaatgagccgtccgccacgaatgaaaaatacctgcaccacagcgtccccctcttcccttgcaaccgccaagacgtcccggtcctcccccggtctccccgcgtccgtaatcttctgcttctccgaaatcttttttacactgctgatcagttcccggtactcaatggccttttcaaattccatctgttctgaagcctccagcatcttctcctctagttctttcagaatgccgtcgtagtgaccggacaaaaactttaccacctcgtcgatagactcccggtactgatcactggaaatatagccctgacacggcgcgtcacactgcttaatgtgataatacagacatggccgttcttttccgatgtctcttggaagcgtcctgccgcagcttctcagccggtagagtttcctcaccatgtcgatgatatccttcaccgcctgagaactcgtaaatggtccaaaatacttcgccttgtccttggcctgccggcgtaccatcataatacgcgggaacggttcctgaactgtcaccttgataaatgggtaggttttgtcatccacaagcatcgtattatacttcggacgatactccttgatcagattgcactccaagacaagtgcttccaattcagagtccgtgacaatatattcaaatctccggatgtgcgtcaccatttgctctatcttgacgcctttatttctgctgctctgaaaatactggcgtacccggtttttcagactgatggctttgccaacataaatgatctcatctttctcgtcgtgcatcagatagaccccaggctttgccggaagctttttcagctcttcttcgatcacaaacatactttcacctcattaactccatctattttaacaaaagaacagcgcatggacaatccccatacgctgatttcttttcttattcgtaacagttcagcatagaagctcggactaaccttgtgctgctccatcttcctcttctgccgtcacagacgtctcctgttctgcctctaacattggcttttctgttgcagttgctgtctccaccggcttcatggcgatcctttcttccttcttttccgaatcgtctgcgatcccccgtacttcatggaagatctgcataaactctttcccggtaattgtctctttctcaatcagaaacgccgcaatcttgtcgagtgcctctctgttttccagcagaagcctctttgcctcatcataggcaactttcagcatctgcatcacttcggagtcgatctccgccgccgttgcctcgccgcagttcatcacggctctgccatccagataccgattctgaatggattccagaccgatcagcccaaacttctctgacattccgtattgggtaatcatggcacgtgccaccttagtagccttctcgatatcattggacgctccggtcgttacagtgtcaaagacaatctcctcagccgcccgtcctgccagaagtccgacaagcattgcttccagctctttctttgtattgagaaatttctcctcctccggcgtctgcatcacatacccaagcgctcccatcgtgcgcggtacaatcgtaatcttctgtaccggctcggagtccttctgaagggcacttacaagcgcatgtccgacttcgtggtaagacacgatcctgcgctcctcctgactcataatccggtctttcttctctttccccacaagaactacttctacagcctcaaacaggtctgcctgacagactgcatgacgtccgtgcttgaccgcattgatcgccgcctcattaatcatattggcaagatctgaccctacggcaccgcttgtggcaagggcaatctcctcgagattgacgctctcgtccatccgcacgtccttggcatgtactttcaaaatatcgacacgacctttcagatccggacgctccacaatgattctccggtcaaaacgtcccggacgaagcaaagccggatctaaaatctccggacgattcgtcgccgccaaaagcaaaagccccttattcgtatcaaatccatccatctctgccagaagctggttgagtgtctgctctctctcatcgttcccgccgagctgagaatctctgctctttcctatggcgtcgatctcatcgataaagataatacatggcgccatctgctgcgcctgcttaaacaggtcacgcactcgggacgcaccgacaccgacatacatctccacaaacgcggatccggacagcgagaaaaacggcacattagcctcgcctgctaccgccttggcaagcagtgttttaccggtacccggaggacctacaagaagcgctccttttggaagcttcgctcccacaccggtatattttcccggattgtgcagaaaatccacgacctcctgcaaagattctttcgcctcatcctgtcccgccacatcacggaacgtaacccccgtagtcttttccacatacattttggcattgctctttccgatccccatcatgcccccactgctttttgatactcttcgcatcagaaaactgagcagcacaaagacaagtacaaacggaacaatcacactgaatacgaggtttaaaatcatcatggatgtagaatccggaatcgtactgctgacctcgactcctgccttgtcaagcttatcgtacatatccggatcatcgatcagcccggtatagtactgcacctgggatccagcgccaaactgcgtaaaccagttgctgccttgggtgatcccgccctggctgttctcattctcctgattcttttccgcctccgtcttcggaatgatcgtaatcttctccgaatcaatggtgacttcctttacttcccccttctccaccatatccatgaatttcgtatacgaaatctcctgggatggcgtatcctgcatgagctgatacagaaacatgacaaaaacagcagcaattatcgtggttatgatgataatcccgtaattctgcctgttattgttatcattctttttattattctgattgtccatccttttcctcctacatgctatcttctatattataagtatgatttccatacaaatcaataaaaacattgtgaaattttggtgagtgaaccgggcttatccatgctgcctgatgaacataccagttgcaaatattttgctcccctctcacaatttgattgcaaatttctgtcagactgtagtatactagtcaggtagtattttcaaactaaaggtatagtatggaacgactcagctatacatcctgaaatcaataaacccttctgtaagcaagcttaagataggtttcgttaatatcgggagacagtgctgaatcgttacaataaaattttacgaaggaatgattagtgtatgaaaacaggatttgataatgacaaatatctccacatgcagtctgaacatatccgagagaggatcagtcactttgacaacaagctgtatctggaattcggaggaaagcttttcgacgacttccatgcttcccgtgtacttccgggatttcagccggacagtaagctgcggcttttaaagcaactctccgacaccgcagagatcgtcatcgtcatcagcgcaggggacattgaaaaaaacaaggtgcgcggcgatcttggaatcacctacgatgacgacgtacttcgcttaaaaggtgcgttcgaggagaacggactctatgttggcagtgttgtcatcacgcagtacagcggccagaaaagtgcggatctcttccgtcaccgcctgaaaaatatgggaatccgtgtctacacccactatattatcgaaggatatccgtccaacatcccgcacatcgtaagtgacgaaggatacggacggaacgactatatcgagacctccaaacctctcgtagtcatcacagctccagggcctggaagcggaaagatggcaacctgtctctcccagctctatcatgagaataagcgtggcatccgcgccggatatgccaagttcgagacattcccgatctggaatatccctctcaaacatccggtgaatctggcgtacgaggctgccacagcagacttaaacgacgtcaatatgatcgatccattccatctggaagcatatggaaagacgactgtcaactataatcgtgacgtagagattttcccggtactcaacgccatgtttgaacagatcttcggcgagagcccgtataagtcaccaactgatatgggtgtcaacatggccggaaactgtatctgcgacgacgaggtgtgccaagaggcatcccgccaggagatcatccgccgctactatcaggcaaaatgtgattttctccagggcaacattccggactccgaagtctttaagttggagcttctgatgaagcaggctcatgtctctatccacgatcgcacagttgtagacgcggcacttgaaagagctgaaaacactggagccgccgctgctgccatcgagctgccggatggaaagattctgaccggaaagacgtccaacttactgggtccttccgcagcgctgatcctcaacgcactgaaggaccttgccggaatcgatcacaatcttcatgtgatctccccgaccgctatcgagccaatccagaaagtcaagacccagtatcttgggagcaagaatccgcggcttcacattgatgagatcctgattgcgctctccatctcctctgcagccaatccggccgcacagctcgcaatggagcagcttccaaagctgaagggctgccaggtacacacctctgtcatgctttcttccgtggatatcaagctctttaaaaaactcggtatccagctcacttgtgagccgaaatacgaacacaatccgatctattaattctgattataaataatagagacgacaaagcccggagccaacacatgctctgggctttgctttgtatctgttctctgtgtcccttttttctatctgtttctttgtgtctgtatcaggaagctgccttactgcttccgttttcaaactgtgaattgtagagatcagcgtaaaatccaccttttgcaaggagttcttcatgcctgccctgctcaacgatgtctccgtctttgagaaccagaatccggtctgcatcccgaatggtggaaagacgatgggcaataatgaaacttgttctgcctttcatcaaattatccattgccttctgaatctggatctccgttcttgtatcaaccgagcttgtcgcttcatccagaataaggatcttcggatctgccaaaatggctcttgcaatggtcagaagctgtttttgcccctgggaaacgttgcttgcctcctcattgagctccatgtcatatccagccggaagtgtctggataaaatgatgggcatgcgccgcctttgctgcctccatgatctcctcatctgtagcgtccagcttgccgtaccggatattatcccggatggaaccgttaaagagccacgtatcctgaagcaccataccgaacatccggcgcagttctccacggttgaaatccctgacattgtgtccgtccacaaggatcgctcctccattgacatcataaaagcgcatcagcagtttaatcagtgtcgtcttaccggcgccggtcggaccgacaatcgcgattttctgtccctccttcactttcgtggagaagtccttgatgatgatatgatctggattgtagccgaatttcacatggtcaaattccacattgccttgaagtccttctgtcgatactggatcatctgcaaactgtacctcttcctcttcctccaaaaactcgaacacacgctcggaagctgctgccatggactgtaacatattcgctacctgtgccacctgctggatcggctgagtgaaatttcgaacgtactggataaaggactggatatccccgacttcgatcgtctgtttgatcgccaggtatccgccaaggatcgtcacccccacatagcccaggttgccgacaaactgcatgatcggcatcatcattccggagaaaaactgcgatttccaagctgtctgatagagcacatcgttcatctcattgaattctttaaggacgtcatcctccttattgaatgcctttacaatactgtggccgccataaacttcctccacctgtccattgacatgccccaggtattcctgctgatttttaaagtatttctgagaatgtttcacaatgaaagaaatcagaaccagcgaaatcgggaggatcaaaagagccaccatcgtcatcaacggactgatacttagcatcatcacaagtacaccgatcagcgttgtcaccgaagtgatcatctgggtcgccgtctggttgagactctgactgaacgtatcgacgtcgtttgtcacacgggagagcacttctccatgggtctttgtatcaaaataattcattggaagtctgttgatcttctctgaaatatctttcctcatccggtacgtaagcttctgtgtaactcccgtcataataaacccctgaataaatgagaagatagagctcacaccatacaggatcagcaaagtaatcaggattctgccgattttgccaaaatcaataccgtctccacctgtcaccttgccgaccaagcccgtaaaaatctccgttgtcgccttaccgagcactttcggcccgataatattgaaaatcgtgctgccgacagcaaagagcataacacacagaatcggaaacttatatggtccgatatatttcagcacccgtttgagagtccctttaaaatcttttgctttctcaccgctgcccatgcgtccgtggccacccatcggtcctcgtctttgattactcatgtgctgcctccccctttctgctgcgtgataccgcctgctccagctctgtctgggaaagctgggacgaagcgatctgataatatgcctcacagtttttcaaaagctcttcgtgggttccgattcctgcaatctgcccctcatcaaggacaatgatctgctccgcatggaggatcgtactgattcgttgagcgataataatgacggtgctgtctttcgtcttttctttcagcgcctgtctgagcacagtgtcggtcttatagtccagtgcagaaaagctgtcgtcgaaaataaagatgtccggatgcttcgccactgctcttgcaatagaaagccgttgcttctgccctccggaaacattgcctcctccttgggagatcggactgtcgtatccatccggtttctcttctatgaattgctttgcctgagcgatcttggctgcttcctggattctctcagaggacatttcctcatcactgtaagcgatattggaagcaatcgtaccagagaacaacattcctttctgcggtacatagccaatcttctctcgaagctcatgttgtgtcacggtgcggatatcctttccgtcaatccggatagacccctccgtcacgtcatagaatcttgggattaagttcaccagcgtagattttccacttcccgtacttccaataattgctgtcgtctcaccaggccttgcgataaaatgaatatcgtgcagcacgtctttacccgcacccggatagcggaaagatacatggtcgaattccaccagtcccttcccttcctccggcagatgttccggtacttcctgatcccggatggcagtctcgcttgtcagtacctcatccacacgtccggctgcaacggcagctcttggaagcataatagagatcatgcagatcataaggaacgccataatgatttgcatcgtgtactggataaatgccatcatatctccaacctgcatctgtccgccatccacaccgtgggcccccacccacacgataagaatactaattccattcataatcaacatcatagccggcatcataaaggtcatggcacggttgacaaagaggttcgtcttcgtcagatcacggttcgctacatcaaaccgctcctcctcatgcttttccgtatggaaggcacggatgacggaaagcccggtcagtatctctcttgtcaccaggttgactcggtccaccatcttttgcaggatgcggaatttcggcatcacgcaaagaaaaagcactagaacaagcgccaggatgagcactactccaagagcgatgatccaggtcatggacacgttggtattgattaccttgtaaacaccacccactgctatgatcggtgcgtagagcaccattctcagcatcattacaatcaccatctgaatctgttggatatcattggtacttcttgtaatcaacgatgccgtggaaaaacggtcaaactcgccactggaaaatccaaccaccttcgtaaatacatttttcctcagatcccgtccgaccgctgccgccgtcctagaggccagaagtccgacggtcacactggcaaggagccctaagaaagcaagaccgagcatcttgacacctgtaatcagaatataatttgtctgcagggcatccatgtcaacccccagactctcatatgccgccttgatgtagaccgccgctgtctgctccagcatcgtatccggcatatcggaaatctgaccggacatgctctctaccattgcatctctctgctcctgcggcaggacccttaaaatgtcaaagatcgttgcatcctccggtactgcgccctgcggcatctgtgccatcatctgatctttcatcgctcccagctcgtcgctgtccgaagaaagtccttctgcaagaagcattggttctcccagaatgtcaaagagttcttcggacttctcctcgtcctctgccacggaatctttcagcacataaaaagattcgtctgtattcagatcctttttcgttccctcccgatatgcttcccggacggtatccgcatctttttgcggaaccaataacaacagatcttccagatcgctttctttcatctgttctggaaccgtcgtatcaattccgccctgctgaattcctacatttacaatatcggacgtgtacgtcggaagggacagatcgcagaatgcctgcacaaacagcacgacgatgatcgcaagaacgacgcctgcatgctgcctgagatacttgaatagttttcccataatcgttttccttctttcttcattaaatttcttcgtctaaatcagacatacattcctgtttcatatggatcttacagctttccatcgcctctttggtcatcagattttcccggatctgaagcaggagccgacggaaaaggagccgttcttccggcagaatgtcccggaacatcgtgccctccatctccttcatcgcatccttgatccgcctgatatagcgcctgccctcgtcgctaagtgtaatccaggagactctctgatcctgttcatcagaacttcgtacgatcagtcctcttgcctccagctttttcagaagcgccgtgatggacggcggtttcactccaagcttttttgcgatctccttctgaggaagcctcccctccttggagaggatgaacagacatcctgcctgccccggcttgagatccacttctttcatacattgcatgacccagtaggtctgggcatgcaaaatctgattgagcaacagaggaaccggaatttccctgattggattattttccataatctttcctcctaattagttagatatctaactgatagtctaatattttgcccaatatatgtcaacctcaaacttattatttcacttttttatcacaatttttcacaaaattttaattaaataactaattaatccggacattccggaaatacccggattttctttcttgtttcttttctctctcctgcgagagaaaaagactgcacccctccaacaaaaaagagcgtctccttttccagaaacgctcctgctccattacacaaaatataataaaccgtttttaaatccggctctgctgtttcgttttgtcaatccaggtaattttcaccttgtaccgctcccggattctgcagtgctctaatgtcaggtggatctcctttttcttcagtacccttgcaatcccttcaaagatatgcatcacctgattttcgtatttcatcactttcctaaatctcttgtagtacggacctccacggagagcctcccccggaagccaggtcttgcgaatattatgagcctggaccttcttcccgttcagaaaaataaattcattgatattccccggtccatcgttcaaatgattgtcaagcttctccggaatctgcctccaaatgtgctccgatcctttcagcaattcaaaaatttctttcgtctcttcccgatccaatttaaaaatcttcatcgtcttgatttcatcaaaaaggcgatacgctacaaacttgagattgccgttgccccgcaattccaacaaaaatccgccgtcgtcgccctccatgccaaaattcgggctgacatggtaagaaaaaacaaccatatctttattcaaatcctgaaactccatagtatccccttacttccgaagtctgtctgtccaacatcagaaattatatcatattttccccggagcttccatgacttttgaatcattttatagaggcatatgaaaaactgatcgcaggatccgacaaagaaagaacctctttcacaatttccagaggcacttacacaatcagatactgtatcgcattaaagaaatatccaacaaacatgattccaaaaaagcagatactaataaaaacaaagagtaatttcggtttgaccgctttacgaagcataatcatagatggaagagacaaagtggtaactgccatcataaaagccagaacaacaccaagttcagcaccctttcccaaaagcgcctcagcaaccggaatagtcccgaaaatatcagcgtacatcggaatccccacaagggtagcaaggacgactccgatcgggttttcttcgccaagcactttcacgataaaggattccggtatccagttatgaatgacggcgccaattccaacacctacgagaatatatggggtcacttttttcacagttccacggacctgatcccatgcaaattccagccgttccttcacgcgcaattctttttgagccgcatgaaacgcaggaacattacggatatactcttccacatactgttcaagctcaagtttctcgatcaaggtgccgcctgcgacagcaatgatcaatcctaacaatacataaatgacggccactttccatccgaagatactcataagaagcagcaaagaagcaagatcgaccattggagaagaaattaaaaaagaaaacgttactccaagcgacaaccccgcatttgtaaacccaataaacaaaggtatcgatgaacaggaacaaaatggcgttactgtcccaagtaatgccgcaatgatattcgctcctgttccctgaaaacgtccaaggatctttttcgatctctccggtgggaaataactctgaatataagaaatcatccatatgagcacgcccaaaagtaccataatctttatcgtatcatagataaaaaactggattgtgcctcctatttttgacgtcgtatccaagccaaatgcttgaagccccgacccgaccagccggttcaaccaatgcatccccagaatttcattctgaaaaaaatcccaaaccatattaaagtcctccataattacacttacgcatcgttaaattgaaatatatctatttaaaatccctaaagaaagtcgtgatgaaatccattttttgacttctatggcacgactcatcttacagttcattattctcaggcaacaatccttgtaaatattgctttgcctgttctaccccactataagaaatagaatagtgggtccattttccctctttccgtccaacaacaattcctgcgtcgcataatattttcatatgatgcgacaatgttggctgtgaaatatttagctcttccagcagcttacaagcacatttttcaccatgtcgaagcaattcaataattttcacacgattttcatcacaaaatgctttaaaaataaccgcaattcttttttcgtccatctctcctgctccttctatgtgttctgccgattctaataccggtttacatgcagtatttttgcaaaagcttcttaattcgttttacagatgtcgtctgcccactgaccagaatctccccatcaaccataagagaaggggctgacaaaacccctaatttcacaatttctattaaatcctctatcttctcgatttcagcgtctattcccagttctttcactgcttcttttgtattttcatacaactggctgcatttctcgcatccttcacctaatactttgatattcatttcccaatcctcctttttaatttctcagcttcatcggcagccccacttcttcttcccaggcagacatgatctttctgatagcggcaggaccgatctttgaaatgaacaccatctgtgaatgttctttttcagggcatggttttacatctatctggtgtccaaccagatcaatctgactccatccttgcccggaaagcaggaaaaatcctttcgcacggtatagatcatcctgaatcactgacaaaaacttcttcatttttcccaattctacctctcctgaaaagtccatgaagagtgttttcggcttcgtctcttctgaatttgtagtttcttcattttccgcccactgatatttcatcaaatcataattccagaaatcaaattctaactttccattgacactcgtactaatttcacataccggattgatttcccgaattttcttttttaattccagaaccctctcctcatcaaccaggtccgttttcgtcagcaatgccaaatgacaatgctttaactgacgagataccgtttccaaatcttctaactgctccaggaaatgaacagcgtccacaagacagatgacaccttgcaattcataagcatccccgcaaagttgtgatgccgcatcaagaatttcttccacattagacggatcgcctaatccggaactttctataaataaatagtcgaacttgtatgccgccatatctgctaatgcctgaacaaaagaaagtctgaggcaggaacagaaaatggatcccctgttaatttccaccattttgatatcgtcattccgtaaaatctctccgtcaatgctcagtttaccaaactcgttctggatgattccaactcgcttatcctttagaatgtccagtaatcttaaaagtattgttgttttaccagcccccagaaagcccgtgaatacataaagtcctgttttgtctgccatactttcttccccctgatcttctatcacatttacttttatcgatatgataagtttattataatctatatatcgataaaagtcaatctgttttctctattcttcaatacagtagcacgccgccttatgtcccggttctacttccctgaataccggagcttcttttttacagatctcctttgcatacggacaccggctataaaaagcacatccttggaaatcctctgtacggaccggttgttctcctgatagcacctgaaagtcttctccctggatataaggatccgggatggccgccaacagcgtctttgtataaggatgcaacggatgttcaaacagcgtttccgtactggtttcctccacaagtgtgccaaggtacatgacgccgatccgatctgagataaagcgtatgacaccgatatcgtgagagataaacagcagactcaaccccaactccattttcagcctcatcagcatgtttaaaatctgagcctgaatggaaacatccagagcggaaacgggctcatcacagacaattagttttggatgtgtcaaaagggctcccgcaatcccaagtctctgtacctgtccaccggaaagctcatgcgggaaacggaagaaatgctcttcggaaagccctactttttccagcatggcaagtacctgttcttttctctttgctttttcagtcaccccatggatctttaaaatctcctccagaatctcgccgatccgaagccggggattcagtgcggagagagaattctggaacaccatctgtaactcacccctgagtgagcgcatctcccgttccttcattttacagagatccttcccctcatacaagatggagccgctgtctgcgggagagagtcccacgatcgcacgtccggttgtagactttccacatccggattcacctacaagcccgtatgtttctcccttttcgatcgtcatggagaggtgatctaccgcgcacattctttcctttttgccaaaccatcctctacccgaaagccgtagtggatatattttcttcaaatctttaatttccaacagagtttctctcataccttcaccacctctttctcttcttttccggccgcatacttccagcattttactttgtgtcccggtgacacttccacaagtggagggggacaattcttacatgtctcatctaccatggcacatcttgtacagaaatgacagccctttggaatatgggaaagagacggcacagtccctcggattgtcggaagctcttgtcctctctttacccgaagatgcggtatacaggcaagaagcccttgggtataagggtggcacggatgctcaaagagttcctctgtctttgcctcctcgaccacctgtccaaggtacatgaccttaacactgtggcaaagcctggagacaacgcccatatcgtgagtgatgaaaagtaccgacatcccaagtctccggttcagatcccggatcagatgcagaatctgctcctgaatcgtaacgtccagggcagtagtcggttcatccgcaatcagaagcttcggctcgcacgccaacgccatggcaatcatgaccctttgctgcattccaccggaaagctcaaagggatatttcttcatactggcatccggattcgggatcccggtaagcctcagcatctcaatgcttttcttccttgcctcctctttggaaagcctcttatgtaacatcaggacttccatgatctgattccctacggtgtgaaccggactgagagaattcagcggatcctggaaaataacggaaatctggttcccacggattgcccgcatctgttccaacggttttgtcaggagattttcgccctcaaacaggattttcccctcatatcgaaccgccgtatcgtgatcccgaagcctgagaatcgactgggacatgacactctttcctgaacctgactctcctacaatccccgcgatctcgccagggtaaatttccaggttgacaccgttcacagcgggcagccagtctttgtgcaccggaaattttacctttagatctttgatttccaataatgtgtcttgcttcttttcttccatcatgcttttttcttacctcctttcaccttcggatccaaataatcccgaagaccatctccaaggaggttcagactgagcacgcataaaataaccgcggctcccggacagatcatcgtccagggcgctctggaaaataccatcttgctggactccagcatatttccccagcttgccgccggagccgggattcccgctccaagaaaacttaaagacgcctccgaaatgatcgcctgggcaaagataaaagatgcctgtaccgtcagcggagaaatgacgcccggtaaaatcatacgccacagaatccggaaattactaaagccctgcactttcgcggcttccacataggtctgttcccggatcacaagggcactcgcacgcaccgttctcgccacacttggtgtatacacaatcgtcagcgccagaatcacattccagctcgacgtaccgagagctgctatcaacgcaatggcaagcaaaattcccggtattgcaataaggccgtcacagattctcatcaaaacctgatcgagtactttaaagtagctggcatagatgccgatgatcgtccccagcacacaggaaaatactgccacacatccccctacccataaggacaccctcgccccatacatcattctcacaaacaaatcccgtccaaactcgtctgtcccaaagagatgcccgtttcccggagcttgcagtcttttcgtcacttccatggcgttcggatcagtggaatgaaatatcggaacaaagattgccagtagtacgatcagtaccaatccggccgcaccgataatcagcgccggatttgcgagaaatttttccttctttagtgttctctgctcccggataattgcttcgctggcagcagagatctcttttcgtctcatcaacatatcttctccttctacctcctccccggcctgagccttggatccgtaaaaccgtacaaaatatctacaacgagattgacaagcacgtacagaagtgttacaaaaagcaccactccctggatgacaaacacatcccgtctgttaatggatgtcagagtcagcatcccaagtcctggaatattgaacaatgtctctgtcacaatcgttccggtaatcagactaccaaaagactgccctatcgccgtgagtatgactggagctccgtttttcagagcatatttcataacaactttcttttctttgagcccctttgcccgtgccgtctgaatataatttttatacagcatctccaaaagggaagaccgtgtcatcctcgtcaggtaagccgcctgtacgattccaagggaaagcgccggcaaaaacaaatatcgcagatgctcgcccagcccatccgcgatgcccgcatatcccgctaccgggaaccactgcagatacacgccaaaaaacagcatcaaaaacatactcagcaaaaatcccggcagagccgatccaaggagagataccgtcacacaagtcagatccagagtggttcccctgtggtaagccgccaggattccaaggggaatcgccaaagccaaagcaatgacctgtgcaaaaaccgccaaacttaaggtcggaagaaaatactccgcaatggcgctcgtcacagtctgatggagaaaataggactctccccagtccccatggagtacattggaaaaccagtctgcgtactgtacaaggaacggccggtcaaacccaagcttcgcattcagctcgttgatctgatccggcgtcgcctccagaccaagaagtgccgttgcaggacctcccggaatcatgtacacaaccagaaaaatcacacaagatacaacgaagagcacagggatcaacgataaaatccgttttaaaatgtatcgaaacataatatgattcctttcatagaataacagcggagtgctcctccacattccgctgttatgatcgtgtgtctcttattccgctacagtcacattccagtaaatcgggaaacgaagataatcgtatcccgccacatcgttgctcattgctgtgacgcctgtatagtggccgagaacagtggctgcactgtattcatacagaaatttctgtaacttctcccatgctgccgccgcttcctcatcggatgccgcggaacggattgcctggattccctcgcttacttcagagctgttcagacctgcccatccactgtccagtacagataactgaattggaagcatattgtaagagttacttgtaatgaacatatcgaactgctgtggattggagcggtgttccatgaacgtgctgaagtcatacgtttccacctctgcattaattccggcctgtttgagctgttcctgcacaaccaaagttgcattgtacatttccggataatcctgtgttgttacaagtacaatcttttcattattatatcctgcctctttcagaagctcttttgctttttccgtatcatgctgattgtagtactcgcttccggcatctgttccccactgcacatccgtaggatcactccagcttgcactcaattcatagagatctggattgccgtacgcggcaagcataatgtcatcacagttcagtgccgcaagcgcagcctgcctgaatgtctggttggccatcacgccctctgttgtattcaagaacaggttaagtgtaccgccacggtctacattcagcgtcagagcactatcgtcagtcagatcctcataattgtcaatcgggatctcctcagcaacatcatactctccactctgaacaccggcaattcttgtggaagcatctgtcacaacatcatagtagatcgtctgtgttgctgcttctttcttgcctgcaagtccgcttgcttcaccttcggaaggctgataatcttcaaaagcttccaactttacatactgatcctgtttccactctgccaccttgtaagggcctgtaccgatatactcactgactccttctgttgtcgcagactccacagcttcctgcggatagatcgctgccgcctgaatcgggctggcaagaatcataataatatcggaagacgcctggttcacctttaaatttaccgtataatcgtccaccttttcaaaaacagaaccgccgatcagcgtattggcttttgctgatacttcaatccagcgattcatggacgctacaacatcatccgccgtcatctcttccccattgtggaatttcaccccctgacgaatcttgatcgtatacgtcataccatcatcgcttactgtgtaggattctgcaagcacaggagtcggctcgtagtccttattcatggcaaacagtgattcatacacatgaacaccgattcctccgacaatattggaattgattgactgctgatccagtgacggagggtttgcagaaatcgcaacatgcagttcctcttttgttccggatgaactcccggaatcccccttatcagaacctgacccaccgctgcatcccgccagcacaagtgctgaactcataagcaacgccgcagcacctataaatgatcttcttttcataatagtacctcctcaatcatacttctatatggttgtcgtagctactatatacaatagaaacctaaaaagcaaattgataattataataggcggtatgtctattttctatttgacaattttttatgaaatatattttttcggaaagcttttctcagcattttcatctattcccacaaacgcaatagacgattgcttgtcatgtaaaaaaacatacgatatactgaactcatcaaataaaggaggtcgggaagatggaaacaaaagatatattaaaaaagatccgcacagatcatcagatcacacaggatgaaatggcagaaaaactagctgtcacaagacaggctgtttcccgctgggagcagggagagtccattccaaatatagatacgctaaagcagatttccaccatttttgatgtttctatcaatacattgctgggaagtccgcgtaaactagtttgtcaatgttgtggtatgcccatggaagacgatactgtgatcagccgggaaaaagatcatagctttaatgaagactattgtaaatggtgttatgcagatggtcagtttgtctaccaaagtatgaacgagctgctcgactttctcgtagaccatatgtcaaacaaccaattcacaccggagcaagtacgtgcctacttttccgaacagcttccaaaactaaaacactggcattagaatcctagatgcagtaacaaaggcacagagcaaaatactctatgccttttcattgcatcatcatttattgatttgatagacgaaactcttttataactttccgcgagtatttataatctccatgaagccgtcataaaataaagatttttcgcttaaagccctatcttcctgtgtatctccgtatatggtgatcttgagaggttggataccattttggcatcataggcaaatatgtttgaaacactataaatgtttacaaaaagacttataatttcatattttcctcgttgctagtatcacaaagtcttttaaatttcagtttactctcatatcatttagctgttttgccttctgatatgcacaatttaaaaattcctgaatagataaatcttcataatcccaattcataggccccagtgttgttgcgccttgatatcctgtaaaagttatctttttcatcatacctctccaatcaatattaccgtcaaaaggaagttgatgctgattatattttccaccattatcatgcaaatgtaacgccattaattgatttccgtacttattcagcaaatcaatatcgggagcataattttgatgatgacaactatcataacaaaaacctacatagcttgactgaaaagtgtttagcaccatatccaggttatctatattttctaaattttcaaaagcaatttgaaccttattatcttccgccttatgaataatcttctctaatctttttaatccaagtttattaatgggataattgtcagctggcaaatggatcaccattgtgggtatattaaaagcaacacaatctttcacgcaatgccaatatgtttcatagacacttcctccattcaaattatccaatgataaacaattctgttcatggacgggcgtatgcatattatctatttccaatccggctttttttgctaaacgaacatcctcctgataacctgatccccttccaaacttatcgctccaccataacatcacacaatcaaatccggcccgttttattagtctgtatctttcttcaaaaggcaaatcgaaacttccaccatatccaaaacaatcatatattcctaccataactacttccccttacatgacaatttcatcttcgatatactatttccttttaggaagatgatattttattcctaattcattatcgccctttttattctgtttataatattctaatgcttcatcgtaaatacaaagataatctaaatttgtaagttttgctttattacgaaaagtatgttcataaaccaaatactcatcaacaagtgttgaaccaacatcaaaaagtagccattctatctttccatatcattttatatcattacagaaaatcctgcgctatttgagcaccaaaacttcaaaatcattgatgttttgagtgctacaacatagcaaaaaataaaactagatttcctcaacaaaatgattttcgtattgataccagtattttttatataccctatcatcattaccgtcaaaattaagctgatacattcgaaaaatcaccgtaatatctttcggctgccaccgctcttcataagagtagcaatacttcatgccaagctttttcattacattcccactgcgtggattttctttgtcatgtgttgctgtgatatatgtcagtccatcctttttcacctgctccaatactgcttttcctgcctcagtcacaatacctctgtgccaaaattctttccgaagtccgtatccaaagtcgtgatgctcctccatatcgacttttatatatccaatggggatatcatcctctttcagacagattgcataagcatatccctgtggtttggcgtattgcgccgcatatctctcttcataaaattcccgcgtttcctccagatttttcatcggaaaccatggcaaaaagcggttgacctcttcatcttttaaaatcagaaaaagtgcctccaaatcgttctctgtaaatttcctcaaaatgagccgttctgtctctaacatcggtgtattcatgtttgctctcctgtttatccaatattcatattaggttcctaaaattcaatctaacgagctttcaatcgttttcatcatttcacgaaatccgtttttctcatagaatctcattccatctatattctgcggaaatacctgtgtcctgataaaatctaccccgtgttcttttccgtaccgcttgcttgcctccataagaagagttccgattccctgactccgccttgattccaatacatccagatcctgtatataaactaatgtttccggtttcaaacatgctacttttttctgctctaatatcataacatgggaaaaacccaatatttttccatcctcttccgccactaaaatatcttgatccgcactttcaaagacagactgaaaaaactcattgcttcgctctcccacaacaaaatgctctggttgatatcgaacgccatcttcctccaattcttgatacaaaagcctcaactgttccacatcgtctattcctgctctcctaattaacatcatttttctccttactcgtctttaattgtttttaaattttctggtttttccattttttctgtttctacaaaggcgtagtggtgtcacgaaaaaggacactaaccatgatatcctgaaacaatcatactgcaatagaaagcaaaatgccatatctctttttaaaatactatctttttcatgcccgttccttatcatttgactatttcctataaaataaaaaacagctttcatctccttcacatcaagaagtgatgtgggacgagtacataagctgttgtatcactgtatttcagaattattagttctattttgtagacaaaacttttctgcgaaaatgcaataatttttttaaccaattacctctcgagaaaaatccccctaaactcaaaacgggtttagagggaataaccggggataataatatacgttataactccgcttttttatatggtggacgaatacatactattaagaaaaaaacaacaaactatgattactcacaagttcattccatgtccctttttcgataattttgccatgatccatacagataatctcatcatatttttctagcagttcttttcttaaatgatgagtaatggtaataatcgttaaattctttatctttaatagacgattttcaatatcataagctgtttgcatatcgacagcagatgtaccttcatctaatatcaagatcggtttgtttctaattaaagcccgcgcaactgcaattctttgcctctgcccgccagataaattcgctccattttctcctacttgatacaataatccctctggaagctctgatataaattcatatagtccactttccattacgactttatcaatcatttcctgtggataatcttcatgtagacatatattgtcctgtatagtttcatcaaacatataaatattttgatgaattatagaggataattgagccacatcatttctatcaagtaaatttaattccctattatcatatttgattgtacctgtataatcagaataatagcccgctaataattttataagagtacttttcccagaaccactttttcctataacaacatattttttccctttttcaatagtacaatttatttcatttaaaatctctttgtgcttatcataggaaaaacctaagtcttttgtgcaaacacaaaaatcaaatgagctgatatgttctttttgtgaatgtgccaatgaatattgagagatattctgcattttttcagcaataggctgtatactttttatctttggaacattagtaaatatcatcacaagaggatttgctaaattactacttacttgtaccattcctaacaatgtacctactgttatacgttctgtgatgatgaaataggcagataaaaataaaacaactatctgaaccataagagcaagaaaagaagatatcccctcatttaatgcaagcaatctatcgacactgtatttagagcggattgtttcttcgttctctttgctaaatcgctgaattacataccgtttcatggaataggacttgataatttcaaatccagacaaaatatcttttaggccgactgtaaaatctgctagttttgaggaatatttcttttgtcttttttccaatgactttcccagaaaactaggaataagaaacatgatagctatcgctactatgacgcaaacagtaacaataatatcaaaataaatcattaacaagaatgacgcagtaaaaataaccgtatattggactacttcaaaaagaggaagcaaaaagttatcttctatcatttttacatcatttgtaataatggaaatatagtcagcagtattcttcttgttgaaatcttctatactgtgatgaactgttccttggaatacatcagaacgaatctgacacttaattttacatataacctttttgctaagtagagattgaagatatagaaaaatccccaatacagcaaaataaaagatagaaaacaaaaccgttctgataaattgttgtatatcttttcccacagctatgtctaatagttgctgtaaaagtatagccataaacacataacctaaagaagagattacactgactaaaatagtagtgataaataagattttattttgcttaatatagcttttcatattatattctcctttgtaattatacgtgttgcatgtatgtatatgcttaaaaataaaattgcctttcgacaatcttatttttcttatgcattttctttgcatagtttaacgatttcttcatcaattactggaagtcctaatttttccataatttcttttatcaataagaatttttcccatgtttcctctgttgtcatcggatatatggtaggtatcgaccaaaaattagttaaaagaacaaataattctgccagtaattttgcatgttctgtttttatagagccatcctgtattccttcttctatcaattcttgatacataggagctaattcttgattgctttcaatcaatttttttaaaaaagccggacttcccatgagttgcattgaagccatacttaattgatgatgttccgtttcatcaaatgaggattttaagacaaattttaacttttccagtccgtttaattctttgtgacttttggctttttcaaaaggattcgtttcatagaaaagtttttcgcacaaagcctcaaagacttcttccttggatttaaaatgatggtaaaaagctcccctggtcagtccgcccatttcacttataatatctaatactgttgtttcctcatatcccttttccaaaaaaagttttaaagaagcatctaatattttttggacagtttcttctggatatttatttcttggcaccttttcacctccaatacatacatactgcatgtatagtatatcatgctgtttacatgtatgtcaacatacctatcaccatttttatagctactaaaaaaaccgattaactttcactacacgaaaattaatcggttataaacaccctttcagatgtatccctgtaccttcaaaaccacatataagtccacattccatcctgctttcctatccaccactgtgctttccacttcaaggacgttcgactcactatgctcgaaagaacctcgctaagttcctcgaacaagcatcgtactaagctctgccttcgcttcgctcctcctcgctaagtgctcttgc
